US008735555B2

(12) United States Patent

Lagarias et al.

(10) Patent No.: US 8,735,555 B2

(45) Date of Patent: May 27, 2014

(54) TRANSGENIC PLANTS COMPRISING A MUTANT PHYTOCHROME AND SHOWING ALTERED PHOTOMORPHOGENESIS

(75) Inventors: John Clark Lagarias, Davis, CA (US); Yi-Shin Su, Davis, CA (US)

(73) Assignee: The Regents of the University of California, Oakland, CA (US)

(*) Notice: Subject to any disclaimer, the term of this patent is extended or adjusted under 35 U.S.C. 154(b) by 1520 days.

(21) Appl. No.: 12/297,418

(22) PCT Filed: Apr. 16, 2007

(86) PCT No.: PCT/US2007/009303

§ 371 (c)(1),
(2), (4) Date: Mar. 5, 2009

(87) PCT Pub. No.: WO2007/123876

PCT Pub. Date: Nov. 1, 2007

(65) Prior Publication Data

US 2009/0300793 A1 Dec. 3, 2009

Related U.S. Application Data

(60) Provisional application No. 60/793,140, filed on Apr. 18, 2006, provisional application No. 60/895,280, filed on Mar. 16, 2007.

(51) Int. Cl.
*C07K 14/415* (2006.01)

(52) U.S. Cl.
USPC .......................................... 530/400; 530/370

(58) Field of Classification Search
None
See application file for complete search history.

(56) References Cited

U.S. PATENT DOCUMENTS

| | | | | |
|---|---|---|---|---|
| 5,614,399 | A | 3/1997 | Quail et al. | |
| 7,795,397 | B2 * | 9/2010 | Lagarias et al. | 530/370 |

FOREIGN PATENT DOCUMENTS

| | | |
|---|---|---|
| WO | WO 93/07279 | 4/1993 |
| WO | WO 94/01571 | 1/1994 |
| WO | WO 2007/123876 | 11/2007 |

OTHER PUBLICATIONS

Kretsch T. et al. The Plant Journal, 2000, vol. 22, No. 3; pp. 177-186.*

Kretsch, T et al. The Plant Journal (2000), vol. 22, No. 3; pp. 177-186.*

Fischer, A. and Lagarias, J. C., PNAS (Dec. 14, 2004); vol. 101, No. 50, pp. 17334-17339.*

International Preliminary Report on Patentability dated Oct. 22, 2008 issued in WO/2007/123876 (PCT/US2007/009303).

Abe et al. (2004) "Microtubule defects and cell morphogenesis in the lefty1lefty2 tubulin mutant of *Arabidopsis thaliana.*" *Plant Cell Physiol* 45(2): 211-220.

An et al. (1985) "New cloning vehicles for transformation of higher plants" *The EMBO Journal* 4(2): 277-284.

Bailey et al. (1995) "The value of prior knowledge in discovering motifs with MEME." *In Proceedings of the Third International Conference on Intelligent Systems for Molecular Biology.* (Menlo Park, CA: AAAI Press) 3: 21-29.

Ballare (2003) "Stress under the sun: spotlight on ultraviolet-B responses." *Plant Physiol* 132: 1725-1727.

Ballare et al. (2000) "Light signals perceived by crop and weed plants." *Field Crops Research* 67: 149-160.

Batschauer et al. (1996) "Blue and UV-A Light-Regulated CHS Expression in *Arabidopsis* Independent of Phytochrome A and Phytochrome B." *The Plant Journal* 9(1): 63-69.

Berkelman et al. (1986) "Visualization of bilin-linked peptides and proteins in polyacrylamide gels." *Analytical Biochemistry* 156: 194-201.

Block et al. (1987) "Engineering herbicide resistance in plants by expression of a detoxifying enzyme" *The EMBO Journal* 6(9): 2513-2518.

Boccalandro et al. (2003) "Increased phytochrome B alleviates density effects on tuber yield of field potato crops." *Plant Physiol* 133: 1539-1546.

Briggs et al. (2002) "Phototropins 1 and 2: versatile plant blue-light receptors." *Trends in Plant Science* 7(5): 204-210.

Butler et al. (1959) "Detection, assay, and preliminary purification of the pigment controlling photoresponsive development of plants." *Proc Natl Acad Sci U S A.* 45(12): 1703-1708.

Cao et al. (1992) "Regeneration of herbicide resistant transgenic rice plants following microprojectile-mediated transformation of suspension culture cells" *Plant Cell Reports* 11: 586-591.

Casal et al. (1997) "The function of phytochrome A." *Plant Cell and Environment* 20: 813-819.

Chan et al. (1993) "*Agrobacterium*-mediated production of transgenic rice plants expressing a chimeric α-amylase promoter/β-glucuronidase gene" *Plant Molecular Biology* 22: 491-506.

Chen et al. (2003) "Characterization of the requirements for localization of phytochrome B to nuclear bodies." *Proc Natl Acad Sci U S A.* 100(24): 14493-14498.

Chen et al. (2004) "Light signal transduction in higher plants." *Ann R Genet* 38: 87-117.

Chen et al. (2005) "Regulation of phytochrome B nuclear localization through light-dependent unmasking of nuclear-localization signals." *Current Biology* 15: 637-642.

(Continued)

*Primary Examiner* — Russell Kallis

(74) *Attorney, Agent, or Firm* — Tom Hunter; Weaver Austin Villeneuve & Sampson LLP

(57) ABSTRACT

This invention pertains to the discovery of mutant phytochromes that when introduced into a plant alter the photomorphogenic properties of that plant. In certain embodiments transfection of plants by nucleic acid constructs expressing the mutant phytochromes produced plants having a phenotype characterized by light-independent activation. Thus, in certain embodiments, this invention provides a transgenic plant or plant cell comprising a mutant phytochrome where the mutant phytochrome is a light-stable phytochrome; and the transgenic plant shows decreased shade avoidance as compared to the same species or strain of plant lacking the mutant phytochrome. In various embodiments the mutant phytochrome comprises a mutation at the position corresponding to tyrosine residue 276 in an *Arabidopsis* phytochrome where the mutation is to a residue other than tyrosine.

6 Claims, 38 Drawing Sheets

(56) References Cited

OTHER PUBLICATIONS

Cornejo et al. (1993) "Activity of a maize ubiquitin promoter in
Chory et al. (1993) "Genetic dissection of signal transduction pathways that regulate CAB gene expression." *Cellular Communication in Plants* pp. 57-62.
Christensen et al. (1992) "Maize Polyubiquitin Genes—Structure, Thermal Perturbation of Expression and Transcript Splicing, and Promoter Activity Following Transfer to Protoplasts by Electroporation." *Plant Mol B* 18: 675-689.
Christou (1997) "Rice transformation: bombardment" *Plant Molecular Biology* 35: 197-203.
Clack et al. (1994) "The phytochrome apoprotein family in arabidopsis is encoded by five genes—The sequences and expression of PhyD and PhyE." *Plant Mol B* 25:413-427.
Clough et al. (1997) "Phytochrome degradation." *Plant Cell and Environment* 20: 713-721.
Clough et al. (1998) "Floral dip: a simplified method for *Agrobacterium*-mediated transformation of *Arabidopsis thaliana.*" *Plant Journal* 16(6): 735-743. transgenic rice." *Plant Mol B* 23: 567-581.
Datta et al. (1992) "Herbicide-resistant Indica rice plants from IRRI breeding line IR72 after PEG-mediated transformation of protoplasts" *Plant Mol B* 20: 619-629.
Davis et al. (2001) "The heme-oxygenase family required for phytochrome chromophore biosynthesis is necessary for proper photomorphogenesis in higher plants." *Plant Physiol* 126: 656-669.
Decoteau et al. (1989) "Mulch Surface Color Affects Yield of Fresh-Market Tomatoes." *Journal of the American Society for Horticultural Science* 114(2): 216-219.
Dieterle et al. (2005) "A new type of mutation in phytochrome A causes enhanced light sensitivity and alters the degradation and subcellular partitioning of the photoreceptor." *The Plant Journal* 41: 146-161.
Elich et al. (1997) "Biochemical characterization of *Arabidopsis* wild-type and mutant phytochrome B holoproteins." *The Plant Cell* 9: 2271-2280.
Emborg et al. (2006) "Multiple heme oxygenase family members contribute to the biosynthesis of the phytochrome chromophore in *Arabidopsis.*" *Plant Physiol* 140: 856-868.
Esteban et al. (2005) "Light-induced conformational changes of cyanobacterial phytochrome cph1 probed by limited proteolysis and autophosphorylation." *Biochemistry* 44: 450-461.
Falciatore et al. (2005) "The evolution and function of blue and red light photoreceptors." *Current Topics in Developmental Biology* 68: 317-350.
Fischer et al. (2004) "Harnessing phytochrome's glowing potential." *Proc Natl Acad Sci U S A.* 101(50): 17334-17339.
Fischer et al. (2005) "Multiple roles of a conserved GAF domain tyrosine residue in cyanobacterial and plant phytochromes" *Biochemistry* 44: 15203-15215.
Franklin et al. (2004) "Light signals, phytochromes and cross-talk with other environmental cues." *Journal of Experimental Botany* 55(395): 271-276.
Franklin et al. (2005) "Phytochromes and Shade-avoidance Responses in Plants." *Annals of Botany* 96: 169-175.
Franklin et al. (2005) "The signal transducing photoreceptors of plants." *International Journal of Developmental Biology* 49: 653-664.
Furuya (1993) "Phytochromes—Their molecular species, gene families, and functions." *Ann R Plant* 44: 617-645.
Furuya et al. (1996) "Photoperception and signalling of induction reactions by different phytochromes." *Trends in Plant Science* 1: 301-307.
Garg et al. (2006) "Light-regulated overexpression of an *Arabidopsis* phytochrome A gene in rice alters plant architecture and increases grain yield." *Planta* 223: 627-636.
Hennig et al. (2001) "Both subunits of the dimeric plant photoreceptor phytochrome require chromophore for stability of the far-red light-absorbing form." *J Biol Chem* 276: 7913-7918.
Hiei et al. (1994) "Efficient transformation of rice (*Oryza sativa* L.) mediated by *Agrobacterlum* and sequence analysis of the boundaries of the T-DNA" *The Plant Journal* 6(2): 271-282.
Hiei et al. (1997) "Transformation of rice mediated by *Agrobacterium tumefaciens" Plant Molecular Biology*35: 205-218.
Hirschfeld et al. (1998) "Coordination of phytochrome levels in phyB mutants of *Arabidopsis* as revealed by apoprotein-specific monoclonal antibodies." *Genetics* 149: 523-535.
Hofmann et al. (1990) "Intracellular Localisation of Phytochrome in Oat Coleoptiles by Electron Microscopy—Dependence on Light Pretreatments and the Amount of the Active, Far-Red-Absorbing Form." *Planta* 180: 372-377.
Hofmann et al. (1991) "Partial Purification of Sequestered Particles of Phytochrome From Oat (*Avena-sativa* L) Seedlings." *Planta* 183: 265-273.
Holsters et al. (1978) "Transfection and Transformation of *Agrobacterium tumefaciens" Molec. Gen. Genet.* 163: 181-187.
Huq et al. (2003) "Nuclear translocation of the photoreceptor phytochrome B is necessary for its biological function in seedling photomorphogenesis." *Plant Journal* 35: 660-664.
Izaguirre et al. (2006) "Remote sensing of future competitors: Impacts on plant defenses." *PNAS* 103(18): 7170-7174.
Izawa et al. (2000) "Phytochromes confer the photoperiodic control of flowering in rice (a short-day plant)." *Plant Journal* 22(5): 391-399.
Jones et al. (1987) "A dominant nuclear streptomycin resistance marker for plant cell transformation" *Mol Gen Genet* 210: 86-91.
Kasperbauer (1987) "Far-red light reflection from green leaves and effects on phytochrome-mediated assimilate partitioning under field conditions." *Plant Physiol* 85: 350-354.
Khanna et al. (2004) "A novel molecular recognition motif necessary for targeting photoactivated phytochrome signaling to specific basic helix-loop-helix transcription factors." Plant Cell 16: 3033-3044.
Kircher et al. (2002) "Nucleocytoplasmic partitioning of the plant photoreceptors phytochrome A, B, C, D, and E is regulated differentially by light and exhibits a diurnal rhythm." *Plant Cell* 14: 1541-1555.
Kong et al. (2004) "Characterization of sunlight-grown transgenic rice plants expressing *Arabidopsis* phytochrome A." *Molecular Breeding* 14: 35-45.
Koornneef et al. (1994) "Photomorphogenic Mutants of Higher Plants." *Photomorphogenesis in Plants—2nd Edition* pp. 601-628.
Kyozuka et al. (1991) "Anaerobic induction and tissue-specific expression of maize Adh1 promoter in transgenic rice plants and their progeny" *Mol Gen Genet* 228: 40-48.
Laemmli (1970) "Cleavage of structural proteins during the assembly of bacteriophage T4." *Nature* 227: 680-685.
Lagarias et al. (1985) "Structure function studies on phytochrome. Identification of light-induced conformational changes in 124-kDa *Avena* phytochrome in vitro." *J Biol Chem* 260(4): 2415-2423.
Lagarias et al. (1987) "Comparative photochemical analysis of highly purified 124 kilodalton oat and rye phytochromes in vitro." *Phorochemisrry and Photobiology* 46(1): 5-13.
Lariguet et al. (2005) "Plant photoreceptors: phylogenetic overview." *Journal of Molecular Evolution* 61: 559-569.
Leisy et al. (1989) "Expression of a rice glutelin promoter in transgenic tobacco" *Plant Molecular Biology* 14: 41-50.
Li et al. (1992) "Phytochrome assembly—Defining chromophore structural requirements for covalent attachment and photoreversibility." *J Biol Chem* 267(27): 19204-19210.
Li et al. (1993) "An improved rice transformation system using the biolistic method" *Plant Cell Reports* 12: 250-255.
Lin (2000) "Photoreceptors and regulation of flowering time." *Plant Physiol* 123: 39-50.
Lin et al. (2005) "The cryptochromes." *Genome Biology* 6(5): 220(0-9).
Lissemore et al. (1988) "Rapid transcriptional regulation by phytochrome of the genes for phytochrome and chlorophyll a/b-binding protein in *Avena sativa." Molecular and Cellular Biology* 8(11): 4840-4850.
MacKenzie et al. (1974) "A specific reversible intracellular localization of phytochrome as Pfr." *Plant Physiol* 53, Abstract No. 5, pp. 1-3.

(56) References Cited

OTHER PUBLICATIONS

Maloof et al. (2001) "Natural variation in light sensitivity of *Arabidopsis*." *Nat Genet* 29: 441-446.
Mathews et al. (1995) "Evolution of the Phytochrome Gene Family and Its Utility for Phylogenetic Analyses of Angiosperms." *Annals of the Missouri Botanical Garden* 82: 296-321.
Mathews et al. (1997) "Phytochrome gene diversity." *Plant Cell and Environment* 20: 666-671.
Matsushita et al. (2003) "Dimers of the N-terminal domain of phytochrome B are functional in the nucleus." *Nature* 424: 571-574.
McCormac et al. (1993) "Photoresponses of Transgenic *Arabidopsis* Seedlings Expressing Introduced Phytochrome B-Encoding cDNAs—Evidence That Phytochrome A and Phytochrome B Have Distinct Photoregulatory Functions." *Plant Journal* 4(1): 19-27.
McCormick et al. (1986) "Leaf disc transformation of cultivated tomato (*L. esculentum*) using *Agrobacterium tumefaciens" Plant Cell Reports* 5: 81-84.
McElroy et al. (1990) "Isolation of an Efficient Actin Promoter for Use in Rice Transformation" *The Plant Cell* 2: 163-171.
Mehrtens et al. (2005) "The *Arabidopsis* transcription factor MYB12 is a flavonol-specific regulator of phenylpropanoid biosynthesis." *Plant Physiol* 138: 1083-1096.
Miller et al. (2006) "Single-molecule dynamics of phytochrome-bound fluorophores probed by fluorescence correlation spectroscopy." PNAS 103(30): 11136-11141.
Mitsuhara et al. (1996) "Efficient Promoter Cassettes for Enhanced Expression of Foreign Genes in Dicotyledonous and Monocotyledonous Plants" *Plant CellPhysiol*. 37(1): 49-59.
Montgomery et al. (2001) "Biliverdin reductase-induced phytochrome chromophore deficiency in transgenic tobacco." *Plant Physiol* 125: 266-277.
Morelli et al. (2002) "Light and shade in the photocontrol of *Arabidopsis* growth [Review]." *Trends in Plant Science* 7(9): 399-404.
Muramoto et al. (1999) "The *Arabidopsis* photomorphogenic mutant hy1 is deficient in phytochrome chromophore biosynthesis as a result of a mutation in a plastid heme oxygenase." *Plant Cell* 11: 335-347.
Muramoto et al. (2002) "Expression and biochemical properties of a ferredoxin-dependent heme oxygenase required for phytochrome chromophore synthesis." *Plant Physiol* 130, 1958-1966.
Nagatani (2004) "Light-regulated nuclear localization of phytochromes." *Current Opinion in Plant Biology* 7: 708-711.
Nagatani et al. (1991) "Phytochrome-B is Not Detectable in the Hy3 Mutant of *Arabidopsis*, Which is Deficient in Responding to End-Of-Day Far-Red Light Treatments." *Plant Cell P* 32(7): 1119-1122.
Nagy et al. (2001) "Intracellular trafficking of photoreceptors during light-induced signal transduction in plants." *J Cell Sci* 114: 475-480.
Nagy et al. (2002) "Phytochromes control photomorphogenesis by differentially regulated, interacting signaling pathways in higher plants." *Annual Review of Plant Biology* 53: 329-355.
Neff et al. (1999) "BAS1: A gene regulating brassinosteroid levels and light responsiveness in *Arabidopsis." PNAS* 96(26): 15316-15323.
Odell et al. (1985) "Identification of DNA sequences required fro activity of the cauliflower mosaic virus 35S promoter" *Nature* 313: 810-812.
Quail (1984) "Phytochrome: a regulatory photoreceptor that controls the expression of its own gene." Trends in Biochemical Sciences 9: 450-453.
Quail (1991) "Phytochrome—A light-activated molecular switch that regulates plant gene expression." *Ann R Genet* 25: 389-409.
Reed et al. (1994) "Phytochrome A and phytochrome B have overlapping but distinct functions in *Arabidopsis* development." *Plant Physiol* 104: 1139-1149.
Robson et al. (1996) "Genetic Engineering of Harvest Index in Tobacco Through Overexpression of a Phytochrome Gene." *Nature Biotechnology* 14: 995-998.
Rocha-Sosa et al. (1989) "Both developmental and metabolic signals activate the promoter of a class I patatin gene" The EMBO Journal 8(1): 23-29.
Rockwell et al. (2006) "Phytochrome structure and signaling mechanisms." *Annual Review of Plant Biology* 57: 837-858.
Rockwell et al. (2006) "The structure of phytochrome. A picture is worth a thousand spectra." *The Plant Cell* 18: 4-14.
Sadasivam et al. (1994) "Isolation and transformation of rice aleurone protoplasts" *Plant Cell Reports* 13: 394-396.
Sawers et al. (2005) "Cereal phytochromes: targets of selection, targets for manipulation?" *Trends in Plant Science* 10(3): 138-143.
Sharrock et al. (2002) "Patterns of expression and normalized levels of the five *Arabidopsis* phytochromes." *Plant Physiol* 130: 442-456.
Sharrock et al. (2004) "Heterodimerization of type II phytochromes in *Arabidopsis." PNAS* 101(31): 11500-11505.
Shillito et al. (1989) "Regeneration of Fertile plants from protoplasts of elite inbred maize." *Biotechnology* 7: 581-587.
Shinomura (1997) "Phytochrome regulation of seed germination." *Journal of Plant Research* 110: 151-161.
Shinomura et al. (1996) "Action Spectra for Phytochrome A- and B-Specific Photoinduction of Seed Germination in *Arabidopsis thaliana." PNAS* 93: 8129-8133.
Shinomura et al. (1998) "Mode of phytochrome B action in the photoregulation of seed germination in *Arabidopsis thaliana." Plant Journal* 13(5): 583-590.
Shinomura et al. (2000) "Elementary processes of photoperception by phytochrome a for high-irradiance response of hypocotyl elongation in *Arabidopsis." Plant Physiol* 122: 147-156.
Smith (1992) "The Ecological Functions of the Phytochrome Family—Clues to a Transgenic Programme of Crop Improvement." *Photochem P* 56(5): 815-822.
Smith (1994) "Phytochrome Transgenics: Functional, Ecological and Biotechnological Applications." *Seminars in Cell Biology* 5: 315-325.
Smith (1995) "Physiological and Ecological Function Within the Phytochrome Family." *Ann R Plant* 46: 289-315.
Smith et al. (1990) "Phytochrome, a Family of Photoreceptors with Multiple Physiological Roles." *Plant Cell and Environment* 13: 695-707.
Smith et al. (1997) "Antagonistic but complementary actions of phytochromes A and B allow optimum seedling de-etiolation." *Plant Physiol* 114: 637-641.
Smith et al. (1997) "The shade avoidance syndrome: Multiple responses mediated by multiple phytochromes." *Plant Cell and Environment* 20: 840-844.
Snowden et al. (1996) "Intron position affects expression from the tpi promoter in rice." *Plant Molecular Biology* 31: 689-692.
Speth et al. (1987) "Intracellular localization of phytochrome and ubiquitin in red-light-irradiated oat coleoptiles by electron microscopy." *Planta* 171: 332-338.
Stockhaus et al. (1989) "Correlation of the expression of the nuclear photosynthetic gene ST-LS1 with the presence of chloroplasts." *The EMBO Journal* 8(9): 2445-2451.
Stockhaus et al. (1992) "Serine-To-Alanine substitutions at the amino-terminal region of phytochrome-A result in an increase in biological activity." *Gene Dev* 6: 2364-2372.
Svab et al. (1990) "Aminoglycoside-3"-adenyltransferase confers resistance to spectinomycin and streptomycin in *Nicotiana tabacum." Plant Molecular Biology* 14: 197-205.
Svab et al. (1990) "Stable transformation of plastids in higher plants." *PNAS* 87: 8526-8530.
Takano et al. (2005) "Distinct and cooperative functions of phytochromes A, B, and C in the control of deetiolation and flowering in rice." *Pl Cell* 17: 3311-3325.
Takimoto et al. (1994) "Non-systemic expression of a stress-responsive maize polyubiquitin gene (Ubi-1) in transgenic rice plants." *Plant Molecular Biology* 26: 1007-1012.
Terry (1997) "Phytochrome Chromophore-Deficient Mutants." *Plant Cell and Environment* 20: 740-745.
Terry et al. (1991) "Holophytochrome Assembly—Coupled Assay for Phytochromobilin Synthase in organello." *J Biol Chem* 266(33): 22215-22221.
Thompson et al. (1987) "Characterization of the herbicide-resistance gene bar from *Streptomyces hygroscopicus." The EMBO Journal* 6(9): 2519-2523.

(56) References Cited

OTHER PUBLICATIONS

Thompson et al. (1987) "Expression in Plants of a Bacterial Gene Coding for Glyphosate Resistance." *Weed Science* 35(Suppl. 1): 19-23.
To et al. (1996) "Characterization of the Light-Responsive Promoter of Rice Chloroplast psbD-C Operon and the Sequence-Specific DNA Binding Factor." *Plant Cell Physiol.* 37(5): 660-666.
Toki et al. (1992) "Expression of a Maize Ubiquitin Gene Promoter-Bar Chimeric Gene in Transgenic Rice Plants." *Plant Physiol* 100: 1503-1507.
Tsukaya et al. (1991) "Sugar-Dependent Expression of the CHS-A Gene for Chalcone Synthase from Petunia in Transgenic *Arabidopsis." Plant Physiol* 97: 1414-1421.
Usami et al. (2004) "Cryptochromes and phytochromes synergistically regulate *Arabidopsis* root greening under blue light." *Plant Cel P* 45(12): 1798-1808.
van der Horst et al. (2004) "Photoreceptor proteins, "star actors of modern times": a review of the functional dynamics in the structure of representative members of six different photoreceptor families." *Accounts of Chemical Research* 37: 13-20.
Verdaguer et al. (1996) "Isolation and expression in transgenic tobacco and rice plants, of the cassava vein mosaic virus (CVMV) promoter." *Plant Molecular Biology* 31: 1129-1139.
von Arnim et al. (1996) "Light Control of Seedling Development." *Ann R Plant Physiol. Plant Mol. Biol.* 47: 215-243.
Wagner et al. (1991) "Overexpression of Phytochrome-B Induces a Short Hypocotyl Phenotype in Transgenic *Arabidopsis." P1 Cell* 3: 1275-1288.
Wagner et al. (2005) "A light-sensing knot revealed by the structure of the chromophore binding domain of phytochrome." *Nature* 438: 325-331.
Waldron et al. (1985) "Resistance to hygromycin B—A new marker for plant transformation studies." *Plant Molecular Biology* 5: 103-108.
Wang (2005) "Signaling mechanisms of higher plant photoreceptors: a structure-function perspective." *Current Topics in Developmental Biology* 68: 227-261.
Weller et al. (2004) "A dominant mutation in the pea PHYA gene confers enhanced responses to light and impairs the light-dependent degradation of phytochrome A." *Plant Physiol* 135: 2186-2195.
Wessel et al. (1984) "A method for the quantitative recovery of protein in dilute solution in the presence of detergents and lipids." *Analytical Biochemistry* 138: 141-143.
Wester et al. (1994) "Transgenic Complementation of the Hy3 Phytochrome B Mutation and Response to PHYB Gene Copy Number in *Arabidopsis." The Plant Journal* 5(2): 261-272.
Xu et al. (1995) "Expression of the rice Osgrpl promoter-Gus reporter gene is specifically associated with cell elongation/expansion and differentiation." *Plant Molecular Biology* 28: 455-471.
Yamaguchi et al. (1999) "Light-dependent translocation of a phytochrome B-GFP fusion protein to the nucleus in transgenic *Arabidopsis." J Cell Biol* 145(3): 437-445.
Yamamoto et al. (1994) "The Promoter of a Pine Photosynthetic Gene Allows Expression of a jS-Glucuronidase Reporter Gene in Transgenic Rice Plants in a Light-Independent but Tissue-Specific Manner." *Plant Cell Physiol.* 35(5): 773-778.
Yano et al. (2001) "Genetic control of flowering time in rice, a short-day plant." *Plant Physiol* 127: 1425-1429.
Yanovsky et al. (2003) "Living by the calendar: how plants know when to flower." *Nature Review of Molecular and Cellular Biology* 4: 265-275.
Yi et al. (2005) "COP1—from plant photomorphogenesis to mammalian tumorigenesis." *Trends in Cell Biology* 15(11): 618-625.
Yin et al. (1997) "Promoter elements required for phloem-specific gene expression from the RTBV promoter in rice." *The Plant Journal* 12(5): 1179-1188.
Yoshihara et al. (1996) "A 45-bp proximal region containing AACA and GCN4 motif is sufficient to confer endosperm-specific expression of the rice storage protein glutelin gene, GluA-3." *FEBS Letters* 383: 213-218.
Zheng et al. (1993) "5' distal and proximal cis-acting regulator elements are required for developmental control of a rice seed storage protein glutelin gene." *The Plant Journal* 4(2): 357-366.
International Search Report and Written Opinion dated Sep. 23, 2008 issued in WO/2007/123876 (PCT/US2007/009303).
Kretsch T. et al., "A new type of mutation in the plant photoreceptor phytochrome B causes loss of photoreversibility and an extremely enhanced light sensitivity", *The Plant Journal*, (2000) vol. 22, No. 3, pp. 177-186.
Franklin, K. et al., "Phytochrome B, D, and E Act Reduntantly to Control Multiple Physiological Responses in *Arabidopsis", Plant Physiology*, Mar. 2003, vol. 13 1, pp. 1340-1346.
Su, Y. et al., "Light-Independent Phytochrome Signaling Mediated by Dominant GAF Domain Tyrosine Mutants of *Arabidopsis* Phytochromes in Transgenic Plants", *The Plant Cell*, Jul. 2007, vol. 19, pp. 2124-2139.

* cited by examiner

Rc (20 µmol $m^{-2}$ $sec^{-1}$)

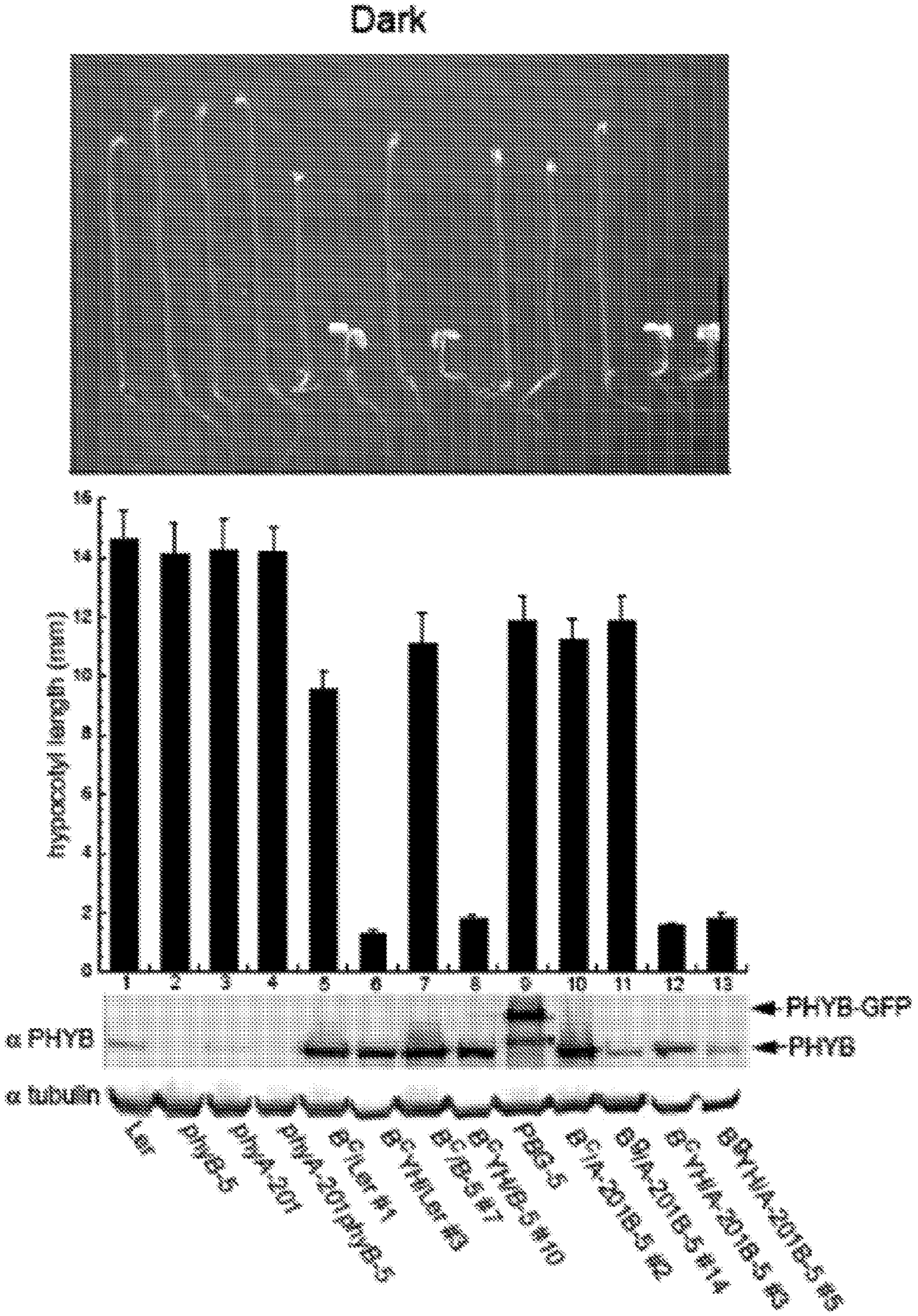
Fig. 7, cont'd

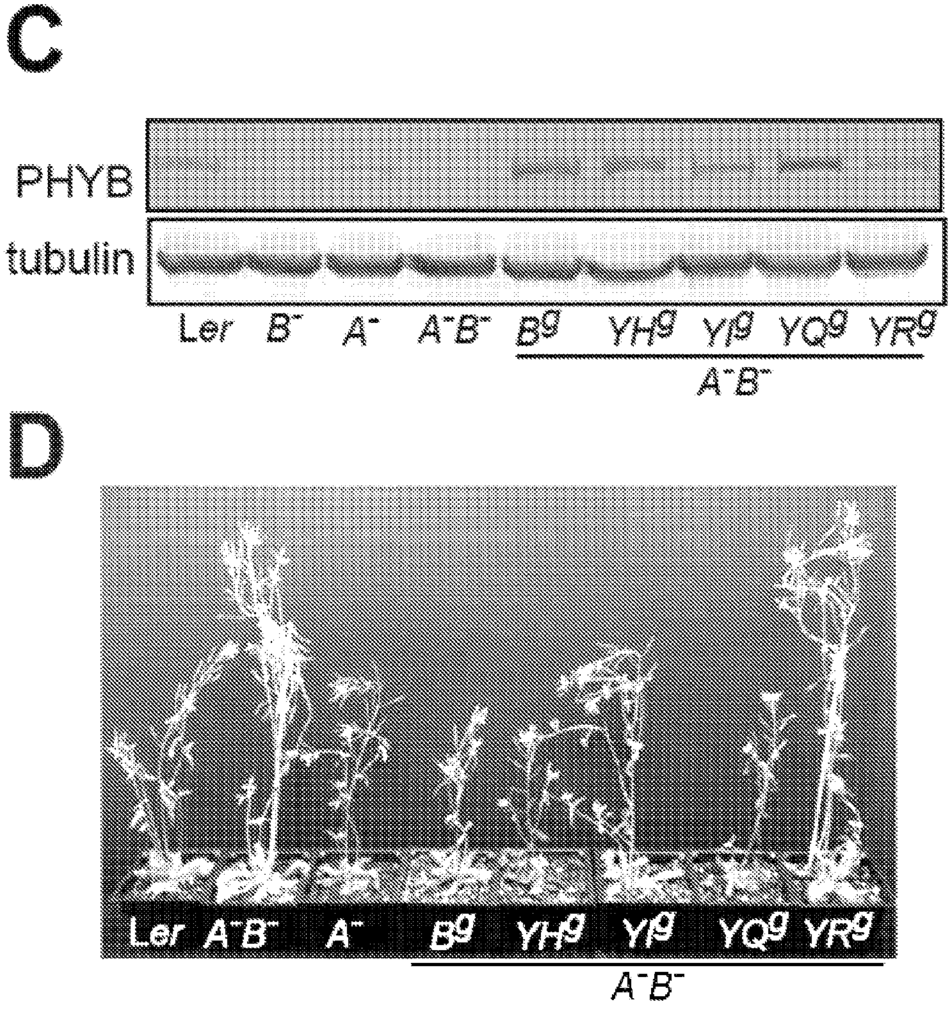
*Fig. 20, cont'd*

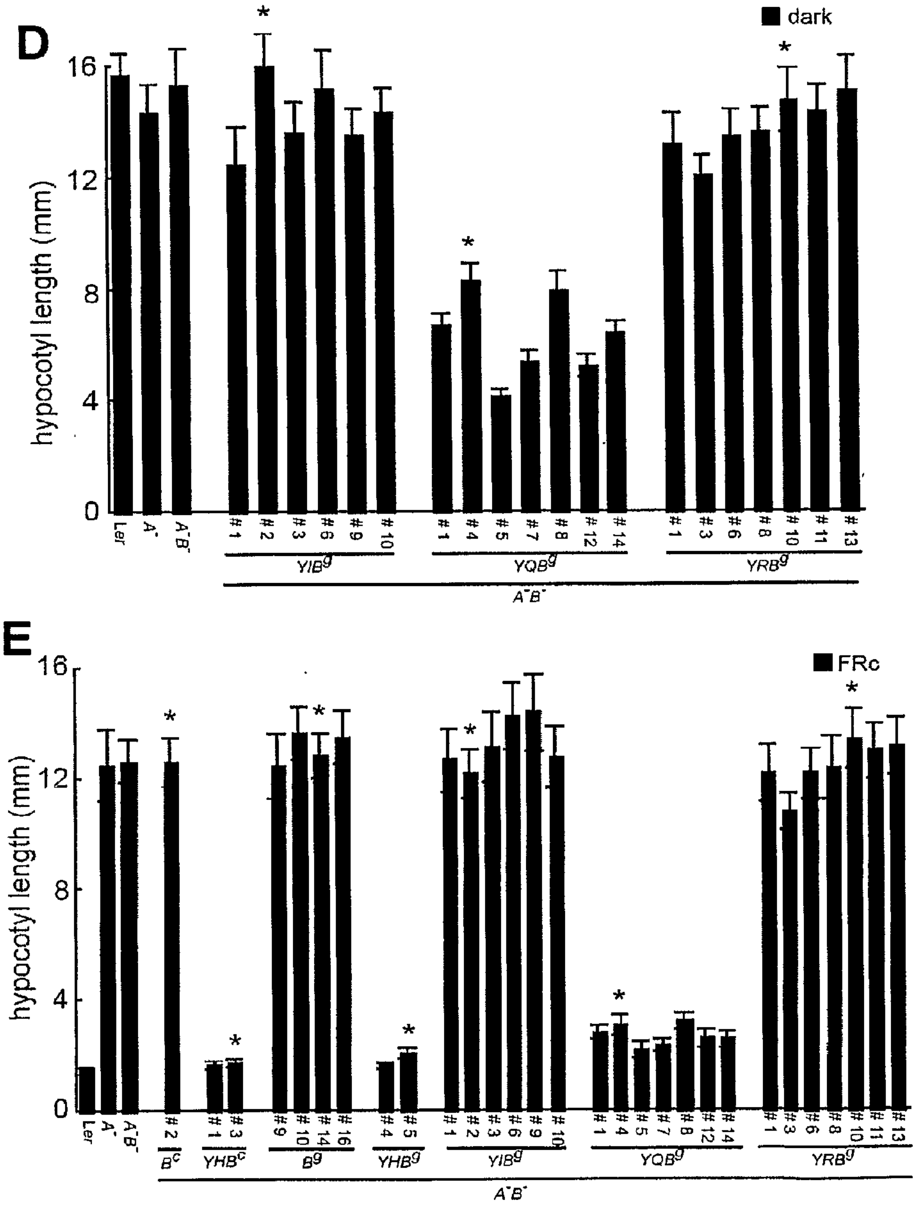
*Fig. 29, cont'd*

TRANSGENIC PLANTS COMPRISING A MUTANT PHYTOCHROME AND SHOWING ALTERED PHOTOMORPHOGENESIS

CROSS-REFERENCE TO RELATED APPLICATIONS

This application is a 371 National Phase of PCT/US2007/009303, filed on Apr. 16, 2007, which claims benefit of and priority to U.S. Ser. No. 60/793,140, filed on Apr. 18, 2006, and to U.S. Ser. No. 60/895,280, filed on Mar. 16, 2007, both of which are incorporated herein by reference in their entirety for all purposes.

STATEMENT AS TO RIGHTS TO INVENTIONS MADE UNDER FEDERALLY SPONSORED RESEARCH AND DEVELOPMENT

This invention was made with Government support under Grant No. R01 GM068552-01, awarded by the National Institutes of Health and Grant No: PHY-0120999, awarded by the National Science Foundation. The Government of the United States of America has certain rights in this invention.

FIELD OF THE INVENTION

This invention pertains to the field of transgenic plants. Mutant transgenic plants are provided that show altered photomorphogenesis (characterized for example, by decreased shade avoidance, and/or increased germination, and/or delayed flowering in high density plantings, etc.).

BACKGROUND OF THE INVENTION

Oxygenic photosynthetic organisms possess sophisticated mechanisms to adapt to their environment. Dependent upon light as an energy source, these organisms must cope with too little and too much light—an environmental factor that is especially challenging for highly pigmented species living in an aerobic environment. Plants therefore possess light receptor systems to recognize and respond to changes in light quality, fluence rate, direction and duration in their environment (Briggs and Spudich eds. (2005) Handbook of Photosensory Receptors (Weinheim: Wiley VCH)). Among the many physiological processes under light control include seed germination, seedling growth, synthesis of the photosynthetic apparatus, timing of flowering, shade avoidance, and senescence. Such light-regulated growth and developmental responses are collectively known as photomorphogenesis (Schäfer and Nagy eds. (2005) Photomorphogenesis in Plants and Bacteria: Function and Signal Transduction Mechanisms (3rd Edition), 3rd Edition (Dordrecht, The Netherlands: Springer)). Phytochrome was the first of the photomorphogenetic photoreceptor families to be identified in plants over 50 years ago (Butler et al. (1959) *Proc. Natl. Acad. Sci. USA* 45: 1703-1708; Rockwell et al. (2006) *Annu. Rev. Plant Biol.,* 57: 837-858).

Synthesized in the red light-absorbing Pr form, plant phytochromes are regulated by red light (R) absorption that initiates the photochemical interconversion to the far red (FR) light-absorbing Pfr form. FR promotes the reverse conversion of Pfr to Pr—a process that typically abolishes the R-dependent activation of the photoreceptor (Schäfer and Nagy eds. (2005) Photomorphogenesis in Plants and Bacteria: Function and Signal Transduction Mechanisms (3rd Edition), 3rd Edition (Dordrecht, The Netherlands: Springer)). This R/FR photoreversibility is conferred by a linear tetrapyrrole (bilin) prosthetic group that is covalently attached to the phytochrome apoprotein (Rockwell et al. (2006) *Annu. Rev. Plant Biol.,* 57: 837-858). Supporting evidence for the central dogma of phytochrome action, that is that Pfr is the active form, has been accumulating for years. Much of this evidence reflects the strong correlation between the amount of Pfr produced by a given fluence of light and the magnitude of the biological response. While the central dogma appears to hold true for R/FR-reversible low-fluence responses (LFR) and for R-dependent very low fluence responses (VLFR) (Shinomura et al. (1996) *Proc. Natl. Acad. Sci. USA* 93: 8129-8133), FR high irradiance responses (FR-HIR) do not conform to this simple view of phytochrome action (Furuya, and Schäfer (1996) *Trends in Plant Sci.,* 1: 301-307; Shinomura et al. (2000) *Plant Physiol.* 122: 147-156). Such data indicate that Pr, Pfr, photocycled-Pr and possibly intermediates produced during Pfr to Pr photoconversion may all function to transduce the light signal depending on the phytochrome.

In flowering plants, phytochromes are encoded by a small family of genes that have arisen by repeated gene duplication of a eukaryote phytochrome progenitor during the course of evolution (Mathews et al. (1995) *Annal. Missouri Botanical Garden* 82: 296-321). In the model plant *Arabidopsis thaliana*, the phytochrome family consists of five genes—denoted PHYA-E (Clack et al. (1994) *Plant Mol. Biol.* 25: 413-427), while monocots species (eg. rice or maize) appear only to possess representatives of the PHYA-C families (Mathews and Sharrock (1997) *Plant Cell Environ.* 20: 666-671; Sawers et al. (2005) *Trends in Plant Science* 10: 138-143). Plant phytochromes can be classified into two groups based upon their light-stability. Phytochromes encoded by the PHYA gene family are responsible for the light-labile pool, while PHYB-E genes encode the light-stable phytochromes (Furuya (1993) *Ann. Rev. Plant Physiol. Plant Mol. Biol.* 44: 617-645). The pronounced light-lability of phyA holoproteins is due to two processes—light-dependent transcriptional repression of the PHYA gene (Quail (1991) *Ann. Rev. Genet.* 25: 389-409) and light-dependent phyA protein turnover (Clough and Vierstra (1997) *Plant Cell Environ.* 20: 713-721). By contrast, the steady state levels of the phyB-E photoreceptors are not significantly regulated by the light environment (Sharrock and Clack (2002) *Plant Physiol.* 130: 442-456). Plant phytochromes are dimeric, with phyA predominantly occurring as homodimers while phyC-E polypeptides forming heterodimers with phyB (Sharrock and Clack (2004) *Proc. Natl. Acad. Sci. USA* 101: 11500-11505). PhyA has been established to be responsible for both VLFR and FR-HIR responses, while the light-stable phytochromes mediate the R/FR photoreversible LFR. Since phyA and phyB are the predominant forms of phytochrome found in light-grown plants (Hirschfeld et al. (1998) *Genetics.* 149: 523-535), null mutants in these genes are deficient in VLFR/FR-HIR and LFR responses, respectively (Shinomura et al. (1996) *Proc. Natl. Acad. Sci. USA* 93: 8129-8133).

Accumulating to high levels in plants grown for prolonged periods in darkness, the light-labile phyA class of photoreceptors function to regulate seed germination and seedling development under very low light fluence rates (Casal et al. (1997) *Environ.* 20: 813-819). Such conditions are encountered for seeds that germinate and develop underground or in the FR-enriched shade of a forest canopy. Dark-grown seedlings accumulate elevated levels of the Pr from of phyA. When such seedlings are exposed to light, phyA is rapidly degraded (Nagy and Schäfer (2002) *Annu Rev Plant Biol* 53: 329-355). The rate of phyA degradation in oat seedlings increases 100-fold upon light exposure—from a half-life of over 100 h for the Pr form to less than 1 h after photoconversion to Pfr (Clough and Vierstra (1997) *Plant Cell Environ.* 20: 713-721). Light-dependent phyA turnover is preceded by the formation of sequestered areas of phytochromes or SAPs in the cytoplasm (MacKenzie et al. (1974) *Plant Physiol.* 53: Abstract No. 5; Speth et al. (1987) *Planta* 171: 332-338). Since SAPs formed under R and white light (W) and can be detected in phyA preparations in vitro, the hypothesis that SAPs represent self-aggregated Pfr:Pfr homodimers has been proposed (Hofmann et al. (1991) *Planta* 183: 265-273; Hofmann et al. (1990) *Planta* 180: 372-377). This assertion has received support from more recent studies with *Arabidopsis* and tobacco seedlings showing that phyA must be translocated to the nucleus to initiate signal transduction (Nagy and Schäfer (2002) *Annu Rev Plant Biol* 53: 329-355; Chen et al. (2004) *Ann. Rev. Genet.* 38: 87-117). In this model, phyA that remains sequestered in the cytosol is eventually degraded and therefore does not participate in signaling. Pr:Pfr heterodimers of phyA that move to the nucleus presumably account for the VLFR and FR-HIR responses. PhyB signaling also involves light-dependent translocation to the nucleus; however, in contrast with phyA, this process can be reversed by FR illumination. Thus it is phyB that is the photoreceptor that is primarily responsible for sensing the R/FR ratio that triggers shade avoidance (Smith and Whitelam (1997) *Plant Cell Environ.* 20: 840-844; Morelli and Ruberti (2002) *Trends in Plant Science* 7: 399-404; Franklin and Whitelam (2005) *Annal. Botany* (*London*)).

Phytochrome-mediated shade avoidance responses observed in high density plantings leads to increased resource partitioning towards elongation growth, reduced lateral branching and early flowering at the expense of seed/fruit crop yield (Sawers et al. (2005) *Trends in Plant Science* 10: 138-143; Smith (1995) *Ann. Rev. Plant Physiol. Plant Mol. Biol.* 46: 289-315). While traditional plant breeding has successfully been used to reduce shade avoidance responses, this process is time-consuming in order to introduce only the necessary gene(s) into the desired cultivar. Genetic engineering would be a more rapid/direct way to accomplish this goal assuming that the desired genes are known. In this regard, transgenic expression of PHYA has already proven successful to reduce shade avoidance losses in agronomically important crop species (Smith (1992) *Photochem. Photobiol.* 56: 815-822; Smith: H. (1994) *Sem. Cell Biol.* 5: 315-325). This approach requires elevated expression of PHYA to produce a sufficient amount of phyA holoprotein to counteract the shade avoidance responses mediated by endogenous light-stable phytochromes (Robson et al. (1996) *Nature Biotechnology* 14: 995-998; Kong et al. (2004) *Molecular Breeding* 14: 35-45; Garg et al. (2005) Planta: 1-10).

SUMMARY OF THE INVENTION

This invention pertains to the discovery of mutant phytochromes that when introduced into a plant alter the photomorphogenic properties of that plant. In certain embodiments transfection of plants by nucleic acid constructs expressing the mutant phytochromes produced plants having a phenotype characterized by light-independent activation. As illustrated by a mutant *Arabidopsis* phytochrome B allele encoding the fluorescent $Tyr_{276}His$ mutation (AtPHYB($Y_{276}H$)), the mutant phytochrome not only complemented light-grown phyB mutants as well as the wild type allele, but also effected 'light-independent' photomorphogenesis. This phenotype is observed whether the AtPHYB($Y_{276}H$) transgene was regulated by its own promoter or by a strong constitutive viral promoter. Unlike phyB mutant plants complemented with the wild type AtPHYB allele, dark grown plants expressing AtPHYB($Y_{276}H$) develop 'as if they were grown in light', exhibiting reduced hypocotyl elongation and development of expanded cotyledons and leaves. AtPHYB($Y_{276}H$) transgenic plants continue to develop in darkness, and may eventually flower if sucrose is present in the growth medium.

It is believed that expressing the YX (or $Y^{GAF}$) alleles of phytochromes (i.e. mutation of the conserved GAF domain tyrosine residue to any of the other 19 conventional amino acids) in any transformable plant species provides an effective means to regulate photomorphogenesis, e.g. reducing yield losses due to shade avoidance responses, enhancing seed germination in low light, modifying the timing of flowering and even propagation of plant germ plasm in darkness.

In certain embodiments this invention provides a transgenic plant or plant cell comprising a mutant phytochrome where the mutant phytochrome is a light-stable phytochrome; and the transgenic plant shows altered photomorphogenesis as compared to the same species or variety of plant lacking the mutant phytochrome. In certain embodiments the altered photomorphogenesis is characterized by a trait selected from the group consisting of reduced yield loss due to a shade avoidance response, and enhanced seed germination in low light. In certain embodiments the mutant phytochrome comprises a mutation at the position corresponding to tyrosine residue 276 in an *Arabidopsis* phytochrome B where the mutation is to a residue other than tyrosine. In certain embodiments the mutant phytochrome comprises a mutation of tyrosine276 to histidine, or to isoleucine, or to glutamine, or to arginine, or to an amino acid that is not a naturally occurring amino acid. In certain embodiments the nucleic acid encoding the mutant phytochrome is under the control of an endogenous promoter or a constitutive promoter. In various embodiments the nucleic acid encoding the mutant phytochrome is under the control of a heterologous promoter. In certain embodiments the mutant phytochrome is derived from the same species as the transgenic plant. In certain embodiments the mutant phytochrome is derived from a species different than the transgenic plant. In certain embodiments the plant part is leaf, a fruit, a seed, or a protoplast. In certain embodiments the plant is a food crop. In certain embodiments the plant is a food crop selected from the group consisting of a cereal, a fruit, a legume, and a root crop. In certain embodiments the plant is a food crop selected from the group consisting of maize (corn), rice, sorghum, wheat, barley, oat, soy, quinoa, potatoes, canola, lettuce, fruit, and beets. In certain embodiments the plant is a food crop selected from the group consisting of Poaceae, Cucurbitaceae, Malvaceae, Asteraceae, Chenopodiaceae, Solanaceae and Brassicaceae. In certain embodiments plant is a non-food crop (e.g., cotton, hemp, flax, oilseed rape, high erucic acid rape, linseed, tobacco, and switchgrass, and the like).

In various embodiments this invention provides a transgenic plant produced from protoplast comprising a nucleic acid encoding a mutant phytochrome, where the mutant phytochrome is a mutant phytochrome as described herein and the transgenic plant shows altered photomorphogenesis (e.g., as described herein) as compared to the same species or variety of plant lacking the mutant phytochrome. In certain embodiments the altered photomorphogenesis is characterized by a trait selected from the group consisting of reduced yield loss due to a shade avoidance response, and enhanced seed germination in low light. In certain embodiments the mutant phytochrome comprises a mutation at the position corresponding to tyrosine residue 276 in an *Arabidopsis* phytochrome B where the mutation is to a residue other than tyrosine. In certain embodiments the mutant phytochrome comprises a mutation of tyrosine276 to histidine, or to isoleucine, or to glutamine, or to arginine, or to an amino acid that is not a naturally occurring amino acid. In certain embodiments the mutant phytochrome is derived from the same species as the transgenic plant. In certain embodiments the mutant phytochrome is derived from a species different than the transgenic plant. In certain embodiments the plant part is leaf, a fruit, a seed, or a protoplast. In certain embodiments the plant is a food crop. In certain embodiments the plant is a food crop selected from the group consisting of a cereal, a fruit, a legume, and a root crop. In certain embodiments the plant is a food crop selected from the group consisting of maize (corn), rice, sorghum, wheat, barley, oat, soy, quinoa, potatoes, canola, lettuce, fruit, and beets. In certain embodiments the plant is a food crop selected from the group consisting of Poaceae, Cucurbitaceae, Malvaceae, Asteraceae, Chenopodiaceae, Solanaceae and Brassicaceae. In certain embodiments plant is a non-food crop (e.g., cotton, hemp, flax, oilseed rape, high erucic acid rape, linseed, tobacco, and switchgrass, and the like). In certain embodiments this invention provides seed from such plants.

Also provided are methods of making a transgenic plant or part thereof. The methods typically involve providing a nucleic acid construct that encodes a mutant phytochrome as described herein and transforming/transfecting a plant with the nucleic acid construct whereby the mutant phytochrome is expressed by the transfected plant. In various embodiments the nucleic acid encoding the mutant phytochrome is operably linked to an endogenous promoter. In certain embodiments the nucleic acid encoding the mutant phytochrome is operably linked to a constitutive promoter. In certain embodiments the nucleic acid encoding the mutant phytochrome is operably linked to a heterologous promoter. In certain embodiments the nucleic acid encoding the mutant phytochrome is derived from the same species as the plant to be transfected. In certain embodiments the nucleic acid encoding the mutant phytochrome is derived from a species different than the plant to be transfected. In certain embodiments the plant is a monocot plant or a dicot plant. In certain embodiments the plant comprises a food crop or a non-food crop.

In various embodiments this invention provides a nucleic acid construct that encodes a mutant phytochrome as described herein. In various embodiments the nucleic acid construct is in a crop plant (e.g., a grain, a cereal, etc.), or a non-crop plant. In certain embodiments the nucleic acid comprises an expression cassette.

Also provided is a mutant phytochrome polypeptide as described herein, e.g., where the mutant phytochrome polypeptide, when present in a plant is a light-stable phytochrome; and results in altered photomorphogenesis as compared to the same species or variety of plant lacking the mutant phytochrome. In certain embodiments the mutant phytochrome comprises a mutation at the position corresponding to tyrosine residue 276 in an *Arabidopsis* phytochrome B where the mutation is to a residue other than tyrosine.

Also provided is the use of a mutant phytochrome as described herein, as a selectable marker. In certain embodiments this invention provides a method of transforming a plant. The method typically comprises cotransfecting the plant with a nucleic acid encoding a gene of interest and a nucleic acid encoding a mutant phytochrome as described herein and selecting transformant(s) by selecting plants showing a phenotype characteristic of a plant containing the mutant phytochrome. In various embodiments the selecting comprises pulsing the transformant with FR, and selecting germinating plants. In various embodiments the selecting comprises pulsing the transformant with FR, and selecting detiolated seedlings. In certain embodiments the cotransfecting comprises transfecting the plant with a first nucleic acid construct encoding the gene of interest and a second nucleic acid encoding the mutant phytochrome. In certain embodiments the cotransfecting comprises transfecting the plant a nucleic acid construct encoding both the gene of interest and the mutant phytochrome.

In certain embodiments the mutation comprising the mutant phytochrome is not a mutation to amino acids Hia, and/or Glu, and/or Gln and/or Trp.

Definitions

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The term also includes variants on the traditional peptide linkage joining the amino acids making up the polypeptide.

The terms "nucleic acid" or "oligonucleotide" or grammatical equivalents herein refer to at least two nucleotides covalently linked together. A nucleic acid of the present invention is preferably single-stranded or double stranded and will generally contain phosphodiester bonds, although in some cases, as outlined below, nucleic acid analogs are included that may have alternate backbones, comprising, for example, phosphoramide (Beaucage et al. (1993) *Tetrahedron* 49(10):1925) and references therein; Letsinger (1970) *J. Org. Chem.* 35:3800; Sprinzl et al. (1977) *Eur. J. Biochem.* 81: 579; Letsinger et al. (1986) *Nucl. Acids Res.* 14: 3487; Sawai et al. (1984) *Chem. Lett.* 805, Letsinger et al. (1988) *J. Am. Chem. Soc.* 110: 4470; and Pauwels et al. (1986) *Chemica Scripta* 26: 1419), phosphorothioate (Mag et al. (1991) *Nucleic Acids Res.* 19:1437; and U.S. Pat. No. 5,644,048), phosphorodithioate (Briu et al. (1989) *J. Am. Chem. Soc.* 111:2321, O-methylphosphoroamidite linkages (see Eckstein, *Oligonucleotides and Analogues: A Practical Approach*, Oxford University Press), and peptide nucleic acid backbones and linkages (see Egholm (1992) *J. Am. Chem. Soc.* 114:1895; Meier et al. (1992) *Chem. Int. Ed. Engl.* 31: 1008; Nielsen (1993) *Nature,* 365: 566; Carlsson et al. (1996) *Nature* 380: 207). Other analog nucleic acids include those with positive backbones (Denpcy et al. (1995) *Proc. Natl. Acad. Sci. USA* 92: 6097; non-ionic backbones (U.S. Pat. Nos. 5,386,023, 5,637,684, 5,602,240, 5,216,141 and 4,469,863; Angew. (1991) *Chem. Intl. Ed. English* 30: 423; Letsinger et al. (1988) *J. Am. Chem. Soc.* 110:4470; Letsinger et al. (1994) *Nucleoside & Nucleotide* 13:1597; Chapters 2 and 3, ASC Symposium Series 580, "Carbohydrate Modifications in Antisense Research", Ed. Y. S. Sanghui and P. Dan Cook; Mesmaeker et al. (1994), *Bioorganic & Medicinal Chem. Lett.* 4: 395; Jeffs et al. (1994) *J. Biomolecular NMR* 34:17*; Tetrahedron Lett.* 37:743 (1996)) and non-ribose backbones, including those described in U.S. Pat. Nos. 5,235,033 and 5,034,506, and Chapters 6 and 7, ASC Symposium Series 580*, Carbohydrate Modifications in Antisense Research*, Ed. Y. S. Sanghui and P. Dan Cook. Nucleic acids containing one or more carbocyclic sugars are also included within the definition of nucleic acids (see Jenkins et al. (1995), *Chem. Soc. Rev. pp* 169-176). Several nucleic acid analogs are described in Rawls, C & E News Jun. 2, 1997 page 35. These modifications of the ribose-phosphate backbone may be done to facilitate the addition of additional moieties such as labels, or to increase the stability and half-life of such molecules in physiological environments.

The term "heterologous" as it relates to nucleic acid sequences such as coding sequences and control sequences, denotes sequences that are not normally associated with a region of a recombinant construct, and/or are not normally associated with a particular cell and/or are not normally associated with a particular strain or species. Thus, a "heterologous" region of a nucleic acid construct is an identifiable segment of nucleic acid within or attached to another nucleic acid molecule that is not found in association with the other molecule in nature. For example, a heterologous region of a construct could include a coding sequence flanked by sequences not found in association with the coding sequence in nature. Another example of a heterologous coding sequence is a construct where the coding sequence itself is not found in nature (e.g., synthetic sequences having codons different from the native gene). Similarly, a host cell transformed with a construct that is not normally present in the host cell would be considered heterologous for purposes of this invention.

The term "recombinant" or "recombinantly expressed" when used with reference to a cell indicates that the cell replicates or expresses a nucleic acid, or expresses a peptide or protein encoded by a nucleic acid whose origin is exogenous to the cell. Recombinant cells can express genes that are not found within the native (non-recombinant) form of the cell. Recombinant cells can also express genes found in the native form of the cell wherein the genes are re-introduced into the cell by artificial means, for example under the control of a heterologous promoter.

The phrase "the position corresponding to tyrosine residue 276 in an *Arabidopsis* phytochrome B" refers to the position in another phytochrome that aligns with *Arabidopsis* phytochrome B tyrosine276 when a sequence alignment is performed between the other phytochrome and aridopsis phytochrome B. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman (1988) *Proc. Natl. Acad. Sci. USA* 85:2444, by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., supra).

Two example of useful algorithms are PILEUP and CLUSTALW (Higgins et al. (1996) *Meth. Enzymol.* 266: 383-402). For example, PILEUP creates a multiple sequence alignment from a group of related sequences using progressive, pairwise alignments to show relationship and percent sequence identity. It also plots a tree or dendogram showing the clustering relationships used to create the alignment. PILEUP uses a simplification of the progressive alignment method of Feng & Doolittle (1987) *J. Mol. Evol.* 35:351-360. The method used is similar to the method described by Higgins & Sharp (1989) *CABIOS* 5: 151-153. The program can align up to 300 sequences, each of a maximum length of 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. For example, a reference sequence can be compared to other test sequences to determine the percent sequence identity relationship using the following parameters: default gap weight (3.00), default gap length weight (0.10), and weighted end gaps.

Another example of algorithm that is suitable for determining percent sequence identity and sequence similarity is the BLAST algorithm, which is described in Altschul et al., (1990) *J. Mol. Biol.* 215: 403-410. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

In addition to calculating percent sequence identity, the BLAST algorithm also performs a statistical analysis of the similarity between two sequences (see, e.g., Karlin & Altschul (1993) *Proc. Natl. Acad. Sci. USA,* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

As used herein "cereal crops" mean a plant yielding a seed containing starch suitable for food or industrial use, as exemplified by, but not limited to, maize (corn), rice, sorghum, wheat, and barley. "Forage crops" are defined as plants that are used as the primary feed of foraging livestock, as exemplified by, but not limited to alfalfa, winter rye, winter/spring wheat, winter/spring triticale, barley, oats, corn (silage), forage sorghum, sudangrasses, switchgrass, sorghum.-sudan hybrid, soybeans, rape and turnip tops/beet tops.

BRIEF DESCRIPTION OF THE DRAWINGS

In FIG. 15A, pictures of twenty three-day-old plants grown under continuous white light (50 μmol $m^{-2}$ $sec^{-1}$) at 20° C. are shown (Scale=1 cm). In FIG. 15B, pictures of five-week-old plants grown under continuous white light (50 μmol $m^{-2}$ $sec^{-1}$) at 20° C. are shown. In FIG. 15C, pictures of five-week-old plants grown under a short day photoperiod (8 h light, 50 μmol $m^{-2}$ sec-1/16 dark) at 20° C. are shown.

FIG. 27A: Mean hypocotyl length (+/−s.d.; n=50) of six-day-old wild-type PHYB- and Y276H-PHYB expressing seedlings grown under continuous red light (Rc) at a fluence rate of 20 μmol $m^{-2}$ $sec^{-}$. Asterisks indicate the representative lines shown in FIG. 16. Genotype and transgene abbreviations are as follows: $B^-$: phyB-5, $A^-$: phyA-201, $A^-B^-$: phyA-201/phyB-5, $B^c$: wild-type PHYB cDNA, $YHB^c$: Y276H-PHYB cDNA, $B^g$: wild-type PHYB genomic DNA, $YHB^g$: Y276HPHYB genomic DNA, PBG-5: PHYB-GFP cDNA. FIG. 27B: PHYB protein levels in six-day-old dark-grown transgenic seedlings were performed as described under Material and Methods. Protein loads of 50 μg per lane were used and immunodetection was performed with monoclonal antiPHYB B6-B3. Anti-tubulin antibody staining is shown as a loading control. FIG. 27C: Mean hypocotyl length (+/−s.d.; n=50) of six-day-old dark-grown wild type and Y276H-PHYB expressing seedlings. Asterisks indicate the representative lines shown in FIG. 16.

DETAILED DESCRIPTION

Figure 1:
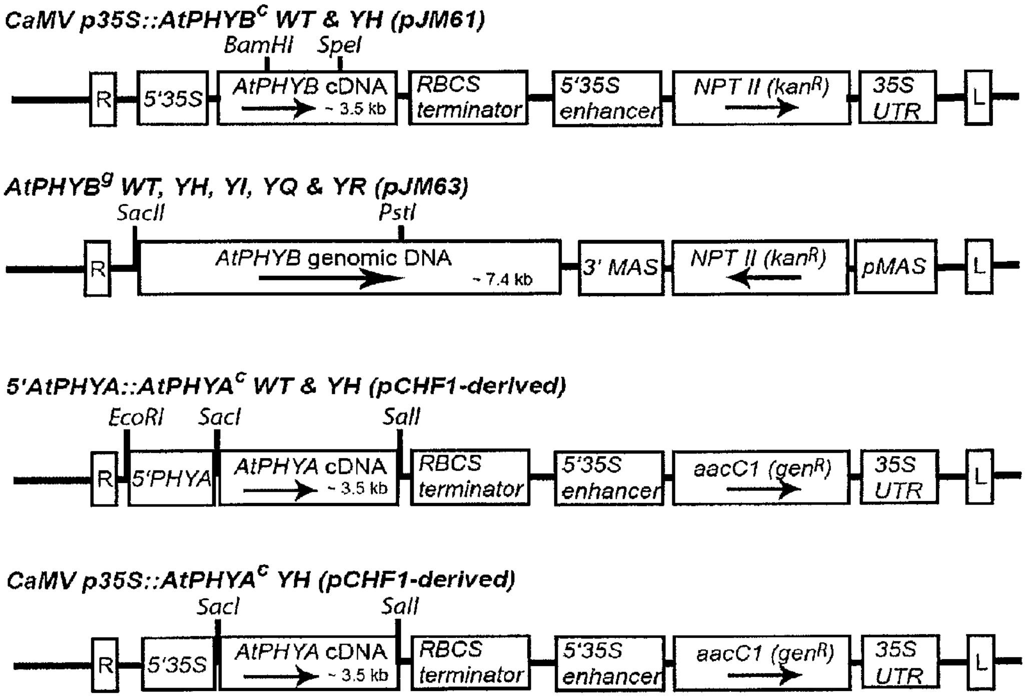
FIG. 1 schematically illustrates binary plant transformation vector constructs used for these studies. T-DNA inserts of the plant transformation vectors for construction of transgenic plants expressing wild type and $Y^{GAF}$ mutants of AtPHYA cDNA and AtPHYB cDNA/genes are indicated between right (R) and left (L) borders. Promoter fragments used to regulate phytochrome cDNA expression include the CaMV 35S promoter (5'35S) and the AtPHYA promoter (5'PHYA). For some constructs, a RUBISCO small subunit (RBCS) transcription terminator was used. Marker genes for plant selection include NPTII conferring kanamycin resistance and aacC1 conferring gentamycin-resistance regulated by enhanced 35S (5'35S) or mannopine synthase (pMAS) promoters. The 3' untranslated region of the CaMV 35S viral transcript (35S UTR) was used for expression of the antibiotic resistance genes in planta. Restriction sites used for cloning purposes are indicated, and the directions of transcription are indicated with arrows. Details for introduction of the $Y^{GAF}$ mutations are described in the Examples.

This invention pertains to the discovery of a mutation in plant phytochromes that confers 'light-independent' activation. As illustrated by a mutant *Arabidopsis* phytochrome B allele encoding the fluorescent $Tyr_{276}$His mutation (AtPHYB ($Y_{276}$H)), the mutant phytochrome not only complements light-grown phyB mutants as well as the wild type allele, but also effects 'light-independent' photomorphogenesis. This phenotype is observed whether the AtPHYB($Y_{276}$H) transgene was regulated by its own promoter or by a strong constitutive viral promoter. Unlike phyB mutant plants complemented with the wild type AtPHYB allele, dark grown plants expressing AtPHYB($Y_{276}$H) develop 'as if they were grown in light', exhibiting reduced hypocotyl elongation and development of expanded cotyledons and leaves. AtPHYB($Y_{276}$H) transgenic plants continue to develop in darkness, and ultimately flower if sucrose is present in the growth medium.

It is believed that expressing the YX alleles of phytochromes in any transformable plant species will provide an effective means to regulate photomorphogenesis, e.g. reducing yield losses due to shade avoidance responses, enhancing seed germination in low light, modifying the timing of flowering and even propagation of plant germ plasm in darkness.

Thus, in certain embodiments, this invention contemplates transgenic plants expressing a YX allele of light-stable phytochromes (e.g., AtPHYB-E) that will exhibit altered photomorphogenesis, (characterized for example, by decreased shade avoidance, and/or increased germination, and/or delayed flowering in high density plantings, etc.). Such plants are believed to be extremely valuable commercially as they require less area, less water, and less fertilizer to cultivate.

In certain embodiments this invention provides transgenic plants expressing a YX allele of a light-labile phytochrome (eg. AtPHYA) that exhibit altered photomorphogenesis, i.e. enhanced shade avoidance.

In various embodiments transgenic plants are provided that express an YX allele of light-stable phytochromes (e.g. AtPHYB-E) grown under complete darkness that can be used to generate chlorophyll-deficient adult plants with novel nutritional, horticultural or agronomic properties.

In certain embodiments transgenic plants are provided that express a YX allele of any eukaryotic phytochrome and that will exhibit altered photomorphogenesis.

It was also a surprising discovery that while light is not required for "activation" the cognate ligand (e.g., a linear tetrapyrrole) of the phytochrome appears to be required or at least to substantially promote 'light-independent' activation. Thus, plants lacking the cognate ligand will not show light-independent activation until the ligand is provided. This provides a method for regulated expression of a YX allele of a phytochrome alone or in fusion with another protein encoding gene in transgenic plants to target cell- and tissue-specific gene expression. Similarly, expression of a YX allele of a phytochrome can be used as bilin- or porphyrin-regulated genetic reporter in plants.

While the method of this invention are illustrated utilizing a mutated *Arabidopsis* phytochrome, it will be appreciated that similarly mutated (e.g. light-stable) phytochromes from essentially any species can be produced and utilized as described herein. In various embodiments the mutated phytochrome is a phytochrome from the plant species or strain that it is desired to transform. In certain embodiments the phytochrome is heterologous to the species it is desired to transform.

I. Mutant Phytochromes.

It was a surprising discovery that plants comprising a mutant phytochrome show altered photomorphogenesis, characterized for example, by decreased shade avoidance, and/or increased germination, and/or delayed flowering in high density plantings, and the like.

In various embodiments the mutant phytochromes are light stable mutants. Such phytochromes include but are not limited to mutant phytochromes that comprise a mutation at the residue corresponding Tyrosine 276 ($Tyr_{276}$) in *Arabidopsis*. The mutation can involve a mutation to any residue other than tyrosine, however, in certain embodiments, the mutation is not to an arginine. Certain preferred mutations include, but are not limited to mutation of the tyrosine to histidine, isoleucine, glutamine, and the like.

The residue corresponding to tyrosine 276 of the *Arabidopsis* phytochrome can readily be determined by one of ordinary skill in the art. The phytochromes are a highly conserved group of molecules and the tyrosine at the position corresponding to *Arabidopsis* phytochrome residue 276 is almost universally conserved. The residue corresponding to tyrosine 276 of the *Arabidopsis* phytochrome can readily be determined by aligning the phytochrome sequence in question with AtPHYB and identifying the residue (Tyr) that aligns with the AtPHYB $Tyr_{276}$. In this regard, a sequence alignment of 122 phytochromes and phytochrome-related proteins is shown in Table 1 and the aligned residues corresponding to *Arabidopsis* Tyr276 are also shown therein. This alignment was used to prepare FIGS. 3 and 4 in Rockwell et al. (2006) *Ann. Rev. Plant Biol.* 57: 837-858, which is incorporated herein by reference.

Without being bound to a particular theory it is believed that other mutations of phytochromes can also produce "light stable" (constitutively active) mutants. Such mutations readily identified using only routine screening. Typically such screening involves introducing one or more mutations into the phytochrome, transfecting a plant and then screening the transformant for a light-stable phenotype, e.g. as illustrated in Example 1.

II. Transfection and Expression of Transgenes.

For the expression of the nucleic acid molecules encoding mutant phytochromes in a plant cell any active promoter can be used. The promoter can be homologous or heterologous with respect to the plant cell to be transformed. In various embodiments the promoter can be tissue-specific, constitutive or inducible. Suitable promoters for expression in plants are known to those of skill in the art. Thus, for example, the constitutive expression 35S promoter of the cauliflower mosaic virus (CaMV) (Odell et al. (1985) *Nature* 313: 810-812; Mitsuhara et al. (1996) *Plant and Cell Physiology* 37: 49-59), or the promoter constructs described in WO 94/01571-A1 and U.S. Pat. No. 6,987,179 which are incorporated herein by reference, have been used.

In certain embodiments promoters that lead to a locally and/or timely limited expression determined/induced by endogenous and/or exogenous factors can also be suitable. Such promoters are know to those of skill in the art (see, e.g., PCT Publication WO 93/07279-A1, which is incorporated herein by reference; Stockhaus et al. (1989) *EMBO J.* 8: 2245-2251, and the like).

For expression in various plant cells, and in particular in wheat cells, suitable promoters include, but are not limited to the 35S promoter (see, e.g. Odell et al. supra; Mitsuhara et al., supra), the ubiquitin promoter (U.S. Pat. No. 5,614,399, Christensen et al. (1992) *Plant Mol. Biol.* 18:675-689; Takimoto et al. (1994) *Plant Mol. Biol.* 26: 1007-1012; Cornejo et al., (1993) *Plant Mol. Biol.* 23: 567-581; Toki et al. (1992) *Plant Phys.* 100: 1503-1507), glutelin promoter (see, e.g., Leisy et al. (1990) *Plant Mol. Biol.* 14: 41-50; Zheng et al., (1993) *Plant J.* 4: 357-366; Yoshihara et al. (1996) *FEBS Lett.* 383: 213-218), the actin promoter (see, e.g., McElroy et al. (1990) *Plant Cell* 2: 163-171), the cab-6 promoter (see, e.g., Yamamoto et al. (1994) *Plant and Cell Physiology* 35: 773-778), the RTBV promoter (see, e.g., Yin et al. (1997) *Plant J.* 12: 1179-1188), the CVMV promoter (see, e.g., Verdaguer et al. (1996) *Plant Mol. Biol.* 31: 1129-1139), the rab 16B promoter, the promoter of the psbD-C operon (see, e.g., To et al. (1996) *Plant and Cell Physiology* 37: 660-666), the Tpi promoter (see, e.g., Snowden et al. (1996) *Plant Mol. Biol.* 31: 689-692), the Osgrp1 promoter (see, e.g., Xu et al. (1995) *Plant Mol. Biol.* 28: 455-471), the Ltp2 promoter (see, e.g., Kalla et al., (1994) *Plant J.* 6: 849-860), the ADH1 promoter (see, e.g., Kyozuka et al. (1991) *Mol. Gen. Genet.* 228: 40-48), the LHCP promoter, and the like.

In certain embodiments apart from promoters, DNA regions initiating transcription of the mutant phytochrome(s) can also contain DNA sequences ensuring a further increase of transcription, such as the so-called enhancer-elements.

In various embodiments, the nucleic acid construct encoding a mutant phytochrome also comprises a termination signal suitable to finalize the transcription and/or to add a poly-A-tail to the transcribed nucleic acid molecule. Examples for a termination signal are the 3'-nontranslatable regions comprising the polyadenylation signal of the nopaline synthase gene (NOS gene) or octopine synthase gene (see, e.g., Gielen et al. (1989), *EMBO J.* 8: 23-29) from agrobacteria, the 3'-nontranslatable region of the gene of the storage protein from soy bean or small subunit of ribulose-1,5-biphosphate-carboxylase (ssRUBISCO), and the like. Optionally, nucleic acid construct comprises a nucleic acid molecule that ensures, e.g., the specific location of transcription and/or translation of the mutant phytochrome in a specific tissue (e.g., endosperm, leaf, stem, tuber, meristem, fruit, root, seed) or cell compartment (e.g., cytosol, apoplast, plastid, mitochondrium, vacuole, lysosome).

The introduction of a nucleic acid constructs of this invention encoding one or more mutant phytochromes into a plant cell is generally carried out using cloning vectors that ensure stable maintenance of the construct in the plant cell and/or stable integration of the nucleic acid molecule into the plant genome.

A large number of cloning vectors are available for introducing a nucleic acid molecule into a higher plant. In various embodiments such cloning vectors can comprise a replication signal for, e.g., *E. coli* and a marker gene for the selection of transformed bacterial cells, e.g., pBR322, pUC series, M13mp series, pACYC184, and the like. The nucleic acid encoding one or more mutant phytochromes can be integrated into the vector at a suitable restriction site by use of one or more restriction endonucleases. The obtained plasmid can be used for the transformation of, e.g., *E. coli* cells. Transformed cells can be cultivated in a suitable medium and subsequently harvested and lysed, and the plasmid DNA recovered by standard methods.

In order to introduce nucleic acid constructs encoding one or more mutant phytochromes of this invention into a plant host cell a wide range of transformation methods and techniques are available. Such methods include, but are not limited to T-DNA transformation by use of *Agrobacterium tumefaciens* or *Agrobacterium rhizogenes*, fusion of protoplasts, injection of the nucleic acid construct (e.g., DNA construct), electroporation of the nucleic acid construct, the introduction of the nucleic acid construct by membrane permeation (PEG), introduction of the nucleic acid construct by means of the biolistic method and others.

If whole plants are to be regenerated from transgenic plant cells, a selectable marker gene can be present. If the Ti- or Ri-plasmid is used, e.g., for transformation of the plant cell, at least the right border, preferably, the right and left border of the Ti- and Ri-plasmid T-DNA is desirably linked with the polynucleotide to be introduced into the plant cell as a flanking region. If Agrobacteria are used for transformation, the DNA to be introduced can be cloned into either an intermediate vector or binary vector. Due to sequence homologies to the sequences of the T-DNA, the intermediate vectors may be integrated into the Ti- or Ri-plasmid of the *Agrobacterium* by homologous recombination. The intermediate vectors can also contain the vir-region to facilitate the transfer of the T-DNA. Since intermediate vectors typically cannot replicate in Agrobacteria, a helper plasmid can be used to transfer the intermediate vector to *Agrobacterium* (conjugation).

Binary vectors may replicate in *E. coli* and in Agrobacteria. They typically contain a selectable marker gene and a linker or polylinker which is flanked by the right and the left T-DNA border region. They can be transformed directly into the Agrobacteria (Holsters et al. (1978) *Mol. Gen. Genet.* 163: 181-187). The plasm ids used for the transformation of Agrobacteria can further comprise a selectable marker gene, e.g., the NPT II gene to allow for the selection of the transformed bacteria. The plasmid can optionally comprise further selection marker genes e.g. conferring resistance against antibiotics such as spectinomycin (Svab et al. (1990) *Proc. Natl. Acad. Sci. U.S.A.* 87: 8526-8530; Sval et al. (1990) *Plant. Mol. Biol.* 14: 197-206), streptomycin (Jones et al. (1987) *Mol. Gen. Genet.* 91: 86-91; Svab et al. (1990) Proc. Natl. Acad. Sci. U.S.A. 87: 8526-8530; Svab et al. (1990) *Plant. Mol. Biol.* 14: 197-206), phosphinothricine (De Block et al. (1987) *EMBO J.* 6: 2513-2518), glyphosate (Thompson et al. (1987) *EMBO J.* 6: 2519-2523; Thompson et al. (1987) *Weed Sci.* 35: 19-23 (suppl.)), hygromycin (Waldron et al. (1985) *Plant Mol. Biol.* 5: 103-108, and the like). In various embodiments the *Agrobacterium* host cell contains a plasmid carrying a vir-region. The vir-region facilitates the transfer of the T-DNA into the plant cell. Additional T-DNA may be present. The transformed *Agrobacterium* can be further used for the transformation of plant cells.

The use of T-DNA for the transformation of plant cells is described in European Patent Application EP-A-120 516; in Hoekema (1985) The Binary Plant Vector System Offsetdrukkerij Kanters B. V., Alblasserdam, Chapter V; An et al. (1985) *EMBO J.* 4: 277-287 and the like. Binary vectors are commercially available, e.g., pBIN19 (Clontech Laboraties, Inc., USA).

In certain embodiments for transferring the DNA into the plant cells, plant explants can be co-cultivated with *Agrobacterium tumefaciens* or *Agrobacterium rhizogenes*. Whole plants can be regenerated from infected plant material (e.g., pieces of leaves, stem segments, roots), and also protoplasts or suspension-cultivated plant cells in a suitable medium which allows for the selection of transformed cells (e.g., containing antibiotics or biocides etc.). The obtained plants are screened for the presence of the introduced DNA. Methods of introduce foreign nucleic acid constructs include, but are not limited to the biolistic method, the use of transforming protoplasts, and the like (see, e.g., Willmitzer (1993) Transgenic plants. In Biotechnology, A Multi-Volume Comprehensive Treatise, H. J. Rehm, G. Reed, A. Puhler, P. Stadler, eds., Vol. 2: 627-659, VCH Weinheim-New York-Basel-Cambridge).

The transformation of dicotyledonous plants by Ti-plasmid-vector systems by means of *Agrobacterium tumefaciens* is a well-established method. Agrobacteria can also be used for the transformation of monocotyledonous plants (see, e.g., Chan et al. (1993) *Plant Mol. Biol.* 22: 491-506; Hiei et al. (1994) *Plant J.* 6: 271-282).

Alternative methods for the transformation of monocotyledonous plants include, but are not limited to transformation by means of the biolistic devices, protoplast transformation, electroporation of partially permeabilized cells, the introduction of nucleic acid constructs by means of glass fibers, and the like. References to the transformation of maize include, but are not limited to, PCT Publication WO 95/06128-A1, and European Patent applications EP-A-0 513 849; EP-A-0 465 875, which are incorporated herein by reference. EP-A-292 435 describes a method of obtaining fertile plants starting from mucousless, friable granulous maize callus. Shillito et al. (1989) *Bio/Technology* 7, 581) started from callus-suspension cultures which produce dividing protoplasts that are capable of regenerating whole plants.

With regard to the transformation of plants such as wheat various methods can be applied, e.g., *agrobacterium*-medicated gene transfer (Hiei et al. (1994) Plant J. 6: 271-282; Hiei et al. (1997) *Plant Mol. Biol.* 35: 205-218; Park et al. (1995) *J. Plant Biol.* 38: 365-371), protoplast transformation (see, e.g., Potrykus aned Spangenberg (Eds.) (1995) *Gene transfer to plants*, Springer-Verlag Berlin Heidelberg, pages 66-75; Datta et al. (1992) *Plant Mol. Biol.* 20: 619-629; Sadasivam et al. (1994) *Plant Cell Rep.* 394-396), the biolistic approach (see, e.g., Li et al. (1993) *Plant Cell Rep.* 12:250-255; Cao et al. (1992) *Plant Cell Rep.* 11:586-591; Christou (1997) *Plant Mol. Biol.* 8: 197-203), electroporation (see, e.g., Xu et al. (1995) In *Gene transfer to plants*, I. Potrykus, G. Spangenberg (Eds.), Springer-Verlag Berlin Heidelberg, Pages 201-208).

Once the introduced DNA has been integrated in the genome of the plant cell, it is usually stably integrated and remains within the genome of the descendants of the originally transformed cell. Typically the transformed cell contains a selectable marker gene that allows for selections of transformants in the presence of certain sugars, amino acids, biocids or antibiotics, (e.g., kanamycin, G 428, bleomycin, hygromycin, phosphinothricine, and the like).

After selection the transformed cells can be cultivated under normal conditions and grown to a whole plant (see, e.g., McCormick et al. (1986) *Plant Cell Reports* 5: 81-84). The resulting plants can be cross-bred with plants having the same transformed genetic heritage or a different genetic heritage resulting, for example, in individuals or hybrids that the corresponding phenotypic properties. Two or more generations can be grown in order to ensure the phenotypic feature is stable and transferable. Seeds can be harvested in order to ensure that the corresponding phenotype or other properties remain.

The nucleic acid constructs and transfection/transformation methods described above are intended to be illustrative and not limiting. Using the teachings provided herein, other nucleic acid constructs encoding mutant phytochromes and various plants, plant cells, seeds, and the like, expressing such constructs can readily be produced.

Table 1 shows a sequence alignment of 122 phytochromes and phytochrome-related proteins including the aligned residues corresponding to *Arabidopsis* Tyr276.

| Name/<br>SEQ ID No | Sequence |
|---|---|
| arphyA<br>SEQ ID NO: 1 | ------------------------------------------------------------ |
| asphya3<br>SEQ ID NO: 2 | ------------------------------------------------------------ |
| asphya4<br>SEQ ID NO: 3 | ------------------------------------------------------------ |
| atphya<br>SEQ ID NO: 4 | ------------------------------------------------------------ |
| cpphya<br>SEQ ID NO: 5 | ------------------------------------------------------------ |
| cupphya<br>SEQ ID NO: 6 | ------------------------------------------------------------ |
| gmphya<br>SEQ ID NO: 7 | ------------------------------------------------------------ |
| lephya<br>SEQ ID NO: 8 | ------------------------------------------------------------ |
| lsphya<br>SEQ ID NO: 9 | ------------------------------------------------------------ |
| mgphya<br>SEQ ID NO: 10 | ------------------------------------------------------------ |
| ntphya<br>SEQ ID NO: 11 | ------------------------------------------------------------ |
| omphya<br>SEQ ID NO: 12 | ------------------------------------------------------------ |
| osphya<br>SEQ ID NO: 13 | ------------------------------------------------------------ |
| pcphya<br>SEQ ID NO: 14 | ------------------------------------------------------------ |
| psphya<br>SEQ ID NO: 15 | ------------------------------------------------------------ |
| sbphya<br>SEQ ID NO: 16 | ------------------------------------------------------------ |
| slphya1<br>SEQ ID NO: 17 | ------------------------------------------------------------ |
| slphya3<br>SEQ ID NO: 18 | ------------------------------------------------------------ |
| slphya4<br>SEQ ID NO: 19 | ------------------------------------------------------------ |
| stphya<br>SEQ ID NO: 20 | ------------------------------------------------------------ |
| taphya<br>SEQ ID NO: 21 | ------------------------------------------------------------ |
| zmphya1<br>SEQ ID NO: 22 | ------------------------------------------------------------ |

-continued

| Name/ SEQ ID No | Sequence |
|---|---|
| atphyb SEQ ID NO: 23 | ------------------------------------------------------------ |
| atphyd SEQ ID NO: 24 | ------------------------------------------------------------ |
| gmphyb SEQ ID NO: 25 | ------------------------------------------------------------ |
| lephb1 SEQ ID NO: 26 | ------------------------------------------------------------ |
| lephb2 SEQ ID NO: 27 | ------------------------------------------------------------ |
| npphyB SEQ ID NO: 28 | ------------------------------------------------------------ |
| ntphyb SEQ ID NO: 29 | ------------------------------------------------------------ |
| osphyb SEQ ID NO: 30 | ------------------------------------------------------------ |
| pbphyb1 SEQ ID NO: 31 | ------------------------------------------------------------ |
| pbphyb2 SEQ ID NO: 32 | ------------------------------------------------------------ |
| sbphyB SEQ ID NO: 33 | ------------------------------------------------------------ |
| slphyb SEQ ID NO: 34 | ------------------------------------------------------------ |
| stphyb1 SEQ ID NO: 35 | ------------------------------------------------------------ |
| stphyb2 SEQ ID NO: 36 | ------------------------------------------------------------ |
| zmphyb1 SEQ ID NO: 37 | ------------------------------------------------------------ |
| zmphyb2 SEQ ID NO: 38 | ------------------------------------------------------------ |
| atphyc SEQ ID NO: 39 | ------------------------------------------------------------ |
| osphyc SEQ ID NO: 40 | ------------------------------------------------------------ |
| sbphyc SEQ ID NO: 41 | ------------------------------------------------------------ |
| slphyc SEQ ID NO: 42 | ------------------------------------------------------------ |
| taphyc SEQ ID NO: 43 | ------------------------------------------------------------ |
| zmphyc1 SEQ ID NO: 44 | ------------------------------------------------------------ |
| zmphyc2 SEQ ID NO: 45 | ------------------------------------------------------------ |
| lephye SEQ ID NO: 46 | ------------------------------------------------------------ |
| atphye SEQ ID NO: 47 | ------------------------------------------------------------ |
| inphye SEQ ID NO: 48 | ------------------------------------------------------------ |

-continued

| Name/<br>SEQ ID No | Sequence |
|---|---|
| lephyf<br>SEQ ID NO: 49 | ------------------------------------------------------------ |
| acvphy1<br>SEQ ID NO: 50 | ------------------------------------------------------------ |
| acvphy2<br>SEQ ID NO: 51 | ------------------------------------------------------------ |
| acvphy3<br>SEQ ID NO: 52 | ------------------------------------------------------------ |
| apphy1<br>SEQ ID NO: 53 | ------------------------------------------------------------ |
| cpphy2<br>SEQ ID NO: 54 | ------------------------------------------------------------ |
| mcphy1<br>SEQ ID NO: 55 | ------------------------------------------------------------ |
| mpphy1<br>SEQ ID NO: 56 | ------------------------------------------------------------ |
| msphy1<br>SEQ ID NO: 57 | ------------------------------------------------------------ |
| paphy1<br>SEQ ID NO: 58 | ------------------------------------------------------------ |
| ppphy0<br>SEQ ID NO: 59 | ------------------------------------------------------------ |
| ppphy1<br>SEQ ID NO: 60 | ------------------------------------------------------------ |
| ppphy2<br>SEQ ID NO: 61 | ------------------------------------------------------------ |
| ppphy3<br>SEQ ID NO: 62 | ------------------------------------------------------------ |
| pphy4<br>SEQ ID NO: 63 | ------------------------------------------------------------ |
| psphy<br>SEQ ID NO: 641 | ------------------------------------------------------------ |
| smphy1<br>SEQ ID NO: 65 | ------------------------------------------------------------ |
| aphA<br>SEQ ID NO: 66 | ------------------------------------------------------------ |
| cph1<br>SEQ ID NO: 67 | ------------------------------------------------------------ |
| cwCph1<br>SEQ ID NO: 68 | ------------------------------------------------------------ |
| npCph1<br>SEQ ID NO: 69 | ------------------------------------------------------------ |
| cwCph1a<br>SEQ ID NO: 70 | ------------------------------------------------------------ |
| npCph1a<br>SEQ ID NO: 71 | ------------------------------------------------------------ |
| toCphA<br>SEQ ID NO: 72 | ------------------------------------------------------------ |
| aphB<br>SEQ ID NO: 73 | ------------------------------------------------------------ |

-continued

| Name/<br>SEQ ID No | Sequence |
|---|---|
| atBphP1<br>SEQ ID NO: 74 | ------------------------------------------------------------ |
| atBphP3<br>SEQ ID NO: 75 | ------------------------------------------------------------ |
| avAphB<br>SEQ ID NO: 76 | ------------------------------------------------------------ |
| chBphP1<br>SEQ ID NO: 77 | ------------------------------------------------------------ |
| chBphP2<br>SEQ ID NO: 78 | ------------------------------------------------------------ |
| drbphp<br>SEQ ID NO: 79 | ------------------------------------------------------------ |
| goBphP<br>SEQ ID NO: 80 | ------------------------------------------------------------ |
| krBphP<br>SEQ ID NO: 81 | ------------------------------------------------------------ |
| mmBphP2<br>SEQ ID NO: 82 | ------------------------------------------------------------ |
| paBphP<br>SEQ ID NO: 83 | ------------------------------------------------------------ |
| pfBphP<br>SEQ ID NO: 84 | ------------------------------------------------------------ |
| ppBphP1<br>SEQ ID NO: 85 | ------------------------------------------------------------ |
| ppBphP2<br>SEQ ID NO: 86 | ------------------------------------------------------------ |
| ppkBphP2<br>SEQ ID NO: 87 | ------------------------------------------------------------ |
| psBphP1<br>SEQ ID NO: 88 | ------------------------------------------------------------ |
| psBphP2<br>SEQ ID NO: 89 | ------------------------------------------------------------ |
| pssBphP1<br>SEQ ID NO: 90 | ------------------------------------------------------------ |
| pssBphP2<br>SEQ ID NO: 91 | ------------------------------------------------------------ |
| pstBphP1<br>SEQ ID NO: 92 | ------------------------------------------------------------ |
| rcPpr<br>SEQ ID NO: 93 | ------------------------------------------------------------ |
| rlBphP<br>SEQ ID NO: 94 | ------------------------------------------------------------ |
| atBphP2<br>SEQ ID NO: 95 | ------------------------------------------------------------ |
| brBphP<br>SEQ ID NO: 96 | ------------------------------------------------------------ |
| rpBphP1N<br>SEQ ID NO: 97 | ------------------------------------------------------------ |
| rpBphP2N<br>SEQ ID NO: 98 | ------------------------------------------------------------ |

-continued

| Name/<br>SEQ ID No | Sequence |
|---|---|
| rpBphP3N<br>SEQ ID NO: 99 | ------------------------------------------------------------ |
| rpBphP4N<br>SEQ ID NO: 100 | ------------------------------------------------------------ |
| rpBphP5N<br>SEQ ID NO: 101 | ------------------------------------------------------------ |
| rpBphP6N<br>SEQ ID NO: 102 | ------------------------------------------------------------ |
| rrBphP<br>SEQ ID NO: 103 | ------------------------------------------------------------ |
| rsBphP1<br>SEQ ID NO: 104 | ------------------------------------------------------------ |
| rsBphP1a<br>SEQ ID NO: 105 | ------------------------------------------------------------ |
| toCphB<br>SEQ ID NO: 106 | ------------------------------------------------------------ |
| xaBphP<br>SEQ ID NO: 107 | ------------------------------------------------------------ |
| xcBphP<br>SEQ ID NO: 108 | ------------------------------------------------------------ |
| anFPH1<br>SEQ ID NO: 109 | ------------------------------------------------------------ |
| bfFPH2<br>SEQ ID NO: 110 | ------------------------------------------------------------ |
| chFPH1<br>SEQ ID NO: 111 | ------------------------------------------------------------ |
| cnFPH1<br>SEQ ID NO: 112 | MPDGSTSPREPANSTYSTHEPQSKRHSSPQSVAMPAAPRFHRQHTSSQDHGSSSTPISPA |
| gmFPH1<br>SEQ ID NO: 113 | ------------------------------------------------------------ |
| gzFPH1<br>SEQ ID NO: 114 | ------------------------------------------------------------ |
| ncFPH1<br>SEQ ID NO: 115 | ------------------------------------------------------------ |
| ncFPH2<br>SEQ ID NO: 116 | ------------------------------------------------------------ |
| umFPH1<br>SEQ ID NO: 117 | ------------------------------------------------------------ |
| aphC<br><br>SEQ ID NO: 118 | ------------------------------------------------------------ |
| cph2<br>SEQ ID NO: 119 | ------------------------------------------------------------ |
| npCph2a1<br>SEQ ID NO: 120 | ------------------------------------------------------------ |
| npCph2a2<br>SEQ ID NO: 121 | ------------------------------------------------------------ |
| npCph2b<br>SEQ ID NO: 122 | ------------------------------------------------------------ |
| arphyA | ------------------------------------------------------------ |
| asphya3 | ------------------------------------------------------------ |

-continued

| Name/ SEQ ID No | Sequence |
|---|---|
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |

-continued

| Name/ SEQ ID No | Sequence |
| --- | --- |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |

-continued

| Name/ SEQ ID No | Sequence |
|---|---|
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ASSTGPLSPSIPPGSFVFPIRSVFQGMVHSDSSNGITEGHQQRKKDGLQRSSGSSSPLRS |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |

-continued

| Name/ SEQ ID No | Sequence |
|---|---|
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |

-continued

| Name/ SEQ ID No | Sequence |
| --- | --- |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |

-continued

| Name/ SEQ ID No | Sequence |
|---|---|
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |

-continued

| Name/ SEQ ID No | Sequence |
|---|---|
| cnFPH1 | PALSDAHRFSTDAAGALHDEPDAGIQTIAQLLQQDRSAPLKEKGKHQPGVATFVG-KAER |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |

-continued

| Name/ SEQ ID No | Sequence |
|---|---|
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |

-continued

| Name/ SEQ ID No | Sequence |
|---|---|
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |

-continued

| Name/ SEQ ID No | Sequence |
|---|---|
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ----------------------------------------------------MSQSSDQI |
| cnFPH1 | DRNGSGGGETLKPSSPDASGHLGNSPITHSSSDSEHQKQQDVAKSSRSEEGTNDSPESSH |
| gmFPH1 | -----------------------------------------------------------M |
| gzFPH1 | ----------------------------------------------------MDVPHDKE |
| ncFPH1 | ---------------------------------------------------------MET |
| ncFPH2 | ------------------------------------------------------------ |
| umFPH1 | ------------------------------------------------------------ |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |

-continued

| Name/ SEQ ID No | Sequence |
| --- | --- |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |

-continued

| Name/ SEQ ID No | Sequence |
|---|---|
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |

-continued

| Name/ SEQ ID No | Sequence |
|---|---|
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | --------------------MSELPSRS-------------------------------- |
| bfFPH2 | ------------------------------------------------------------ |
| chFPH1 | P-----------------QDGSSAPDNG------------------------------HH |
| cnFPH1 | GSGGTLKQATRTDLPAALQRSSTVKGKVSASG---------LTKPSPSNYRHFPSEHHSG |
| gmFPH1 | GQDL--------------PNLRTSPSD--------------------------------- |
| gzFPH1 | GQDISQPEQKDNEEQQHNPSSTTLPSESYPPPPQSSTASSSTFRPSGPDVLPGLQTNTHN |
| ncFPH1 | GMDHTQDTTPTAEGHGQLGNSYQTPDQLAANN-------------------IKVQDYIDN |
| ncFPH2 | ------------------------------------------------------------ |
| umFPH1 | --------------------MSSPPQK--------------------------------- |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |

-continued

| Name/ SEQ ID No | Sequence |
|---|---|
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |

-continued

| Name/ SEQ ID No | Sequence |
|---|---|
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |

-continued

| Name/ SEQ ID No | Sequence |
|---|---|
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ----ISPRD--PSPGETPGRDPSTPSTDAGVG---------YSASQDAPSFGAYDRVYP- |
| bfFPH2 | ------------MSNIDTVPSKSVVYPSVEEFQVERIFPIRNLVNGKGVDTESTSPNTDD |
| chFPH1 | QFSTVSPVAEEPSSPSAATDAIDFAATQPS---QRSRASTTET--TGPLSPSTSDRVFP- |
| cnFPH1 | QRERRFSTVNKVNPPSRNSSSHPVDASHPPNPELQHPVPRRNTRQQHTQDAEGNNRTSSH |
| gmFPH1 | ---ATPTRTTRAASSAAPSEQNSIANSDPP-FSPWSVGSDKQLGYHSAASDISGDRVFP- |
| gzFPH1 | NNNATPTRTTRAASSAAPSEQNSVSNSETP-FSPWSVSSDKQLGYHSAASDVSGDRVFP- |
| ncFPH1 | TALATDLHANDASNSSATADGGSSAITSPTNLSSWSASSDRQLGHGSVQDPE--DRVFP- |
| ncFPH2 | ---------------MDPMSQP-----------IERVFPIR-------LSILESSAFLRN |
| umFPH1 | -----ANRRAPQASAPPTLSHTPTSSATAAASATASATPMQATPSSLRSPTVSQPFIYP- |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |

-continued

| Name/ SEQ ID No | Sequence |
|---|---|
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |

-continued

| Name/ SEQ ID No | Sequence |
|---|---|
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |

-continued

| Name/ SEQ ID No | Sequence |
| --- | --- |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | -IRSLVSLEPPATSEPSSNKS-------------------KSPLSPTSGARQFSIIDGHT |
| bfFPH2 | VSSSNSSCRGPTSAREPYDKD-------------------DILNDSHSDGSSETNFLPPP |
| chFPH1 | -IRSAISVDPSPTPKSQNAQG-----------------DYFHPFSRTNDPRLATDIR--- |
| cnFPH1 | GSRTSLEVDESGMRSLISDMSGIVLLGEAGSWGSMGGSGVSGSKGTDGGTGTTGTLDSAS |
| gmFPH1 | -IRSVISVDPNSSKIASEDY--------------------FPTLPERDGRSIPVHIPGAP |
| gzFPH1 | -IRSVISVDPSSSKITNNDY--------------------FHALPQCDGRGIPVKVPSTS |
| ncFPH1 | -IRSVISVDLAATPPVNDDIRARRRISLSEGYATSAGAGNTATPTRPHASTVPTAKSGAI |
| ncFPH2 | VSDADDLLSVVPVTQQLSN---------------------QHLSPPSSDGSRCEPLPSAT |
| umFPH1 | -MRSAVSIKPLKNDLSTSHPP-------------------DAPISAAKSASRPASAEGPK |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | --------------------------MSGS-------------------------RPSQS |

-continued

| Name/ SEQ ID No | Sequence |
|---|---|
| asphya3 | --------------------------MSSS-------------------------RPASS |
| asphya4 | --------------------------MSSS-------------------------RPASS |
| atphya | --------------------------MSGS-------------------------RPTQS |
| cpphya | --------------------------MSTS-------------------------RPSQS |
| cupphya | --------------------------MSSS-------------------------RPSQS |
| gmphya | --------------------------MSTS-------------------------RPSQS |
| lephya | --------------------------MSSS-------------------------RPSQS |
| lsphya | --------------------------MSTT-------------------------RPSQS |
| mgphya | --------------------------MSSS-------------------------RPTQS |
| ntphya | --------------------------MSSS-------------------------RPSQS |
| omphya | --------------------------MASS-------------------------QPGRS |
| osphya | --------------------------MSSS-----------------------RPTQCSS |
| pcphya | --------------------------MSSS-------------------------RPANS |
| psphya | --------------------------MSTT-------------------------RPSQS |
| sbphya | --------------------------MSSS-----------------------RPAHSSS |
| slphya1 | --------------------------MASR-------------------------AQSQS |
| slphya3 | --------------------------MASP-------------------------AQSQS |
| slphya4 | --------------------------MASP-------------------------AQSQS |
| stphya | --------------------------MSSS-------------------------RPSQS |
| taphya | --------------------------MSSS---------------------------RAA |
| zmphya1 | --------------------------MSSL-------------------------RPAQS |
| atphyb | --------------------------MVSGVGGSGGGRGGGRGGEEEPSSSHTPNNRRGG |
| atphyd | --------------------------MVS--GGGSKTSGG----EAASSGHRRSRHTSAA |
| gmphyb | --------------------------MLQQ--------------AERRIPPFRRRKSTPH |
| lephb1 | --------------------------MAS------------------GSRTKHSYHNSSQ |
| lephb2 | --------------------------MAS----------------GSGSRGKHDRNHQPK |
| npphyB | --------------------------MAS---------------GSRTKHSHQSGQGQGQ |
| ntphyb | --------------------------MAS-----------------GSRTKHSHQSGQGQ |
| osphyb | --------------------------MAS--------GSRAT-PTRSPSSARPAAPRHQH |
| pbphyb1 | --------------------------MAS------------------QSQRQSNQRQHQN |
| pbphyb2 | --------------------------MAS--------------------QSQRQSNQPVH |
| sbphyB | --------------------------MAS----GSRATPTRS-PSSARPEAPRHAHHHHH |
| slphyb | --------------------------MES------------------------------R |
| stphyb1 | --------------------------MAS--------------------GSRTKHSHHSS |
| stphyb2 | --------------------------MAS--------------------GSRTKHSHHSS |
| zmphyb1 | --------------------------MAS----GSRATPTRS-PS--SARPEAPRHAHHH |
| zmphyb2 | --------------------------MAS----DSRP-PKRS-PS----ARRVAPRHAHH |
| atphyc | --------------------------MSS----------------------------NTS |
| osphyc | -------------------------MSSS----------------------RSNNRATCS |

-continued

| Name/ SEQ ID No | Sequence |
|---|---|
| sbphyc | --------------------------MSSPL----------------------NNRGTCS |
| slphyc | --------------------------MSSS----------------------------TS |
| taphyc | --------------------------MSSS---------------------RSNNRPACS |
| zmphyc1 | --------------------------MSLP----------------------SNNRRTCS |
| zmphyc2 | --------------------------MSSP----------------------SNNRGTCS |
| lephye | --------------------------MESQSSENRRGGGGRT-----SLNQNKQNNNKDS |
| atphye | -------------------------------------------------------MGFES |
| inphye | --------------------------MENYG------------------------KAVTF |
| lephyf | --------------------------MSSSSTTN---------------------KTNCS |
| acvphy1 | --------------------------MSST-------------------------RHSYS |
| acvphy2 | --------------------------MSSKT----------------MTYSSSAAEPRSS |
| acvphy3 | --------------------------MATP------------------------------ |
| apphy1 | --------------------------MSTS----------------------KAATYNSS |
| cpphy2 | --------------------------MSAP-------------------------KKTYS |
| mcphy1 | --------------------------MSTS------------------------RMSQSS |
| mpphy1 | --------------------------MSTT-------------------------KVTYS |
| msphy1 | --------------------------MSSS----------------------------KR |
| paphy1 | --------------------------MSTTRP-------------------RAATHSASS |
| ppphy0 | --------------------------MSTP------------------------KKTYSS |
| ppphy1 | --------------------------MSTP------------------------KKTYSS |
| ppphy2 | --------------------------MSTP-------------------------KLAYS |
| ppphy3 | --------------------------MSAP------------------------KKTYSS |
| ppphy4 | --------------------------MSTT-------------------------KLAYS |
| psphy1 | -----------------------------------------------------MASNSRH |
| smphy1 | --------------------------MSTT-------------------------KLTYS |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |

-continued

| Name/ SEQ ID No | Sequence |
|---|---|
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ----------VPDRTTDDFGPFTEQIRGTIDGMGTAEFDALPVGAIQVDGSGVIHRYNRT |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | WTRLRSDSRANSTDYSGGTGLSPESSEAPSSQRMS------------------------- |
| bfFPH2 | YPPIPPDDQIRR------------------------------------------------ |
| chFPH1 | RASQGSLTSQSS-----------HASQRAWAMRHG-----------------------PG |
| cnFPH1 | IDSGHATGGRGQGDERQVTKASLAAKHGARQTSRQDSVRSFI-QSQAGTTNLQDPNAPTL |
| gmFPH1 | RADTGSDLRRSD-TVPANYHSRAHSERIDTLMRRK-------------NTMSGPMSSIQL |
| gzFPH1 | RADIGPDLRRSD-TVPANYHSRAHSERIDALMRRK-------------NTMSGPMSRIQL |
| ncFPH1 | DVESRPTVSQSQSSVSQPDGSSVFSSSSAGTMRHKR----------RMNAMTGSLSSVQA |
| ncFPH2 | DRQANPQDSSS------------------------------------------------- |
| umFPH1 | --------------------------SSPT---------------------KFPTFKPPP |

-continued

| Name/ SEQ ID No | Sequence |
|---|---|
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | SEGSRRSRHSARI----------------------------IAQTTVDAKLHADFEES-- |
| asphya3 | SSSRNRQSSQARV----------------------------LAQTTLDAELNAEYEES-- |
| asphya4 | SSSRNRQSSRARV----------------------------LAQTTLDAELNAEYEES-- |
| atphya | SEGSRRSRHSARI----------------------------IAQTTVDAKLHADFEES-- |
| cpphya | SSNSGRSRHSTRI----------------------------IAQTSVDANVQADFEES-- |
| cupphya | SSNSARSKHSARI----------------------------IAQTSIDAKLHAEFEES-- |
| gmphya | SSNSRRSRHSARM-----------------------------AQATVDAKIHATFEES-- |
| lephya | STTSSRSKHSARI----------------------------VAQTSIDAKLHADFEES-- |
| lsphya | SNNSGRSRNSARI----------------------------IAQTTVDAKLHATFEES-- |
| mgphya | SGSSGRSKHSARI----------------------------IAQTTVDAKLHADFEES-- |
| ntphya | STTSARSKHSARI----------------------------IAQTTIDAKLHADFEES-- |
| omphya | STNSAQSRQSARI----------------------------IAQTSIDAKLDADFEES-- |
| osphya | SSSRTRQSSRARI----------------------------LAQTTLDAELNAEYEEY-- |
| pcphya | SSNPGRANQNARV-----------------------------VLTTLDAKIHADFEES-- |
| psphya | SNNSGRSRNSARI----------------------------IAQTTVDAKLHATFEES-- |
| sbphya | SSSRTRQSSQARI----------------------------LAQTTLDAELNAEYEES-- |
| slphya1 | STNSGRSKHSARI----------------------------IAQTIQDAKFHAEFEES-- |
| slphya3 | STNSGRSKHSARI----------------------------IAQTIQDAKLHAEFEES-- |
| slphya4 | STNSGRSKHSARI----------------------------IAQTIQDAKLHAEFEES-- |
| stphya | STTSSRSKHSARI----------------------------IAQTSIDAKLHADFEES-- |
| taphya | SSSSSRNRQSTQE--------------------------RVLAQTTLDAELNAEFEES-- |
| zmphya1 | SSSSSRTRQSSQA--------------------------RILAQTTLDAELNAEYEES-- |
| atphyb | EQAQSSGTKSLRPRSN------------------TESMSKAIQQYTVDARLHAVFEQS-- |
| atphyd | EQAQSSANKALRSQNQQPQNH----------GGGTESTNKAIQQYTVDARLHAVFEQS-- |
| gmphyb | EQRLSHHSSNNNNNI--------------------DSMSKAIAQYTEDG-VHAVFEQS-- |
| lephb1 | GQAQSSGTSNMNYKD---------------------SISKAIAQYTADARLHAVFEQS-- |
| lephb2 | NQSQFSGTSNTNALS------------------------KAVAQYTTDARLHAAFEQS-- |
| npphyB | VQAQSSGTSNVNYKD---------------------SISKAIAQYTADARLHAVFEQS-- |
| ntphyb | VQAQSSGTSNVNYKD---------------------SISKAIAQYTADARLHAVFEQS-- |
| osphyb | HHSQSSGGSTSRAGGGGGGGGGGGGG-----AAAAESVSKAVAQYTLDARLHAVFEQS-- |
| pbphyb1 | QAAQSSGTSNMRQHHHA-----------------TESVSKAIAQYTVDAQLHAVFEQS-- |
| pbphyb2 | NQAQSSGTSNMRQHHHA-----------------TESVSKAIAQYTVDAQLHAVFEQS-- |
| sbphyB | HHSQSSGGSTSRAGGGGGGGGGGGGGTAATATATATESVSKAVAQYTLDARLHAVFEQS-- |

-continued

| Name/ SEQ ID No | Sequence |
|---|---|
| slphyb | NEGSRTNNNNNSNNP-------------------SDTMSRAIAQYTIDARLHAVFEQS-- |
| stphyb1 | SQAQSSGTSNVNYKD---------------------SISKAIAQYTADARLHAVFEQS-- |
| stphyb2 | SQAQSSGTSNVNYKD---------------------SISKAIAQYTADARLHAVFEQS-- |
| zmphyb1 | HHSQSSGGSTSRAGGG---------------AAATESVSKAVAQYTLDARLHAVFEQS-- |
| zmphyb2 | HHSQSSGGSTSRAGAGGGGGG----------AAATESVSKAVAQYNLDARLHAVFEQS-- |
| atphyc | RSCSTRSRQNSRV----------------------------SSQVLVDAKLHGNFEES-- |
| osphyc | RSSSARSKHSARV----------------------------VAQTPMDAQLHAEFEGS-- |
| sbphyc | RSSSARSRHSARV----------------------------VAQTPVDAQLHAEFESS-- |
| slphyc | RNSSVRSRHDAHV----------------------------VIQTPVDAQLASDFEQS-- |
| taphyc | RGSSARSKHSERV----------------------------VAQTPVDARLHAEFEGS-- |
| zmphyc1 | RSSSARSKHSARV----------------------------VAQTPVDAQLHAEFEGS-- |
| zmphyc2 | RSSSARSKHSARV----------------------------VAQTPVDAQLHADFEGS-- |
| lephye | GLNTSSAASNMKNNA----------------------SKAALAQYNADAKLMAEFEQS-- |
| atphye | SSSAASNMKPQPQK-------------------------SNTAQYSVDAALFADFAQS-- |
| inphye | SSSATSNLNTGKA----------------------------IAQYNADAKLMAEFEQS-- |
| lephyf | RGSSARSRRSARV----------------------------IAQTPVDAKLHVEFEES-- |
| acvphy1 | SGGSGKSKHGRRI-----------------------------AQTSANAKLYAAYEES-- |
| acvphy2 | SSSVVGSKHNRRV---------------------------VVAQTTADAKLHAVFEQAQS |
| acvphy3 | ----GGPKTKHSV---------------------------SVAQTRADARLHAAFEGSGD |
| apphy1 | AGSSVRSKQNRRA----------------------------VVQTTVDANVHAVFEQS-- |
| cpphy2 | STTSAKSKHSVRV-----------------------------AQTTADAALEAVYEMS-- |
| mcphy1 | GESTAKTKREVRV-----------------------------AQATADAKLNTAFEAS-- |
| mpphy1 | SGSSAKSKHSVRI-----------------------------VQTTADAKLQAVFEES-- |
| msphy1 | SQSSGRSSTQTRIQNRV-------------------------TQASADAKLSTAFEVS-- |
| paphy1 | GSVSRSSKHSARV----------------------------ITQTPVDAKLQAEFEGS-- |
| ppphy0 | TSSAKSKAHSVRV-----------------------------AQTTADAALQAVFEKS-- |
| ppphy1 | TSSAKSKAHSVRV-----------------------------AQTTADAALQAVFEKS-- |
| ppphy2 | SGSSVKSKHSVRV-----------------------------AQTTADAKLQAVYEES-- |
| ppphy3 | TSSAKSKAHSVRV-----------------------------AQTTADAALHAVFEKS-- |
| ppphy4 | SGSSVKSKHSVRV-----------------------------AQTTADAKLQAVYEES-- |
| psphy1 | TQSQSTGSNNRRSSTN---------------TNTTTNKATAMAQYNSDARLLQVFEQS-- |
| smphy1 | SGSSAKSKHSVRV-----------------------------AQTTADAKLHAVYEES-- |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |

-continued

| Name/ SEQ ID No | Sequence |
|---|---|
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ESRLSGRIPERVIGRNFFTEVAPCTNIPAFSGRFMDGVTSGTLDARFDFVFDFQMAPVRV |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------MRLPSLAARPTGPRRTGVPSRLRWTGSVRHIPTRGRMCWPAPPRPSRR |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ----DSSSARPPSNTTGLRRG----------------DDHTTFTPSSEDSHPQVQEPYE- |
| bfFPH2 | -------------------------------------LPKSPKHDYSTEVGGGEG----- |

-continued

| Name/<br>SEQ ID No | Sequence |
|---|---|
| chFPH1 | KTAQRGPQPIPSQLFNDMSSN----------KSNGSINDDSRSPSFKPEQAPSTKSGISS |
| cnFPH1 | SPMPSGSPPAEGSQDATVSMEDSANNEKQREQQQEEGEAEQQGEEENGQVEQPVAASAED |
| gmFPH1 | DANRHGSSTTPLQLDISTSDN------ETETEESGPTGHSVPAAAPSGHEADVSSAGQSN |
| gzFPH1 | DANRHGSSTAPLELDISMSDNEADADADTETEESGVMGHASANVSAGGLEPDASSAGYSS |
| ncFPH1 | DADRYGKG-RPIELVLGDSSE----------EESDGGADGSGDGGDLGTIGASSSSGRES |
| ncFPH2 | -------------------------------------AASSYNYTYPSSFNKGNGGDDSL |
| umFPH1 | SAPHASHQAHHPEEVHNVTDP------------------ATADITVPVNKDESLCDHPEH |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | -------GSSFDYSTSVRVTGPVVENQPP-------------RSDKVTTTYLHHIQKGKL |
| asphya3 | -------GDSFDYSKLVEAQRDGPPVQQG-------------RSEKVI-AYLQHIQKGKL |
| asphya4 | -------GDSFDYSKLVEAQRDGPPVQQG-------------RSEKVI-AYLQHIQKGKL |
| atphya | -------GSSFDYSTSVRVTGPVVENQPP-------------RSDKVTTTYLHHIQKGKL |
| cpphya | -------GNSFDYSSSVRVTSDVSGDQQP-------------RSDKVTTAYLHHIQKGKL |
| cupphya | -------GDSFDYSSSIRVTSVNTGEQKP-------------RSDKVTTAYLHQIQKAKF |
| gmphya | -------GSSFDYSSSVRVSGTADGVNQP-------------RSDKVTTAYL----RGKM |
| lephya | -------GDSFDYSSSVRVTSVAGDEEKP-------------KSDKVTTAYLHQIQKGKF |
| lsphya | -------GSSFDYSSWVRVSGSVDGDQQP-------------RSNKVTTAYLNHIQRGKQ |
| mgphya | -------GGSFDYSTSVRFTGTVGGDIQP-------------RSDKVTTAYLHQIQRGKL |
| ntphya | -------GDSFDYSSSVRVTSVAGDERKP-------------KSDRVTTAYLNQIQKGKF |
| omphya | -------GSSFDYSTSVRVTNYPAGLSEP-------------RSDKVTTAYLHQIQKGKL |
| osphya | -------GDSFDYSKLVEAQRTTGPEQQA-------------RSEKVI-AYLHHIQRAKL |
| pcphya | -------GNSFDYSSSVRVTSAVGENSSI-------------QSNKLTTAYLHHIQKGKL |
| psphya | -------GSSFDYSSSVRVSGSVDGDQQP-------------RSNKVTTAYLNHIQRGKQ |
| sbphya | -------GDSFDYSKLVEAQRSTPSEQQG-------------RSGKVI-AYLQHIQRGKL |
| slphya1 | -------SNEFDYSSSVRGSTSGVNQL-P-------------KSDKVTSSYLLQIQKGKF |
| slphya3 | -------SNEFDYSSSVRGSTSGVNQL-P-------------QSDKVTSSYLLQIQKGKF |
| slphya4 | -------SNEFDYSSSVRGSTSGVNQL-P-------------KSDKVTSSYLLQIQKGKF |
| stphya | -------GDSFDYSSSVRVTNVAEGEQRP-------------KSDKVTTAYLHQIQKGKF |
| taphya | -------SDSFDYSKLVEAQRDTPTVLQE-------------GRSEKVIAYLQHIQRGKM |
| zmphya1 | -------GDSFDYSKLVEAQRSTPPEQQ--------------GRSGKVIAYLQHIQRGKL |
| atphyb | ---G-ESGKSFDYSQSLKTTTYGSS-----------------VPEQQITAYLSRIQRGGY |
| atphyd | ---G-ESGKSFDYSQSLKTAPYDSS-----------------VPEQQITAYLSRIQRGGY |
| gmphyb | ---G-ESGRSFNYSESIRIASES-------------------VPEQQITAYLVKIQRGGF |
| lephb1 | ---G-ESGKSFDYSQSVKTTTQS-------------------VPERQITAYLTKIQRGGH |
| lephb2 | ---G-ESGKNFDYSQSVRNSTES-------------------VTEHQITAYLNKMQRGGH |

-continued

| Name/ SEQ ID No | Sequence |
|---|---|
| npphyB | ---G-ESGKSFDYSQSVKTTTQSV------------------VPEQQITAYLTKIQRGGH |
| ntphyb | ---G-ESGKSFDYSQSIKTTTQSV------------------VPEQQITAYLTKIQRGGH |
| osphyb | ---G-ASGRSFDYTQSLRASPTPS-------------------SEQQIAAYLSRIQRGGH |
| pbphyb1 | ---G-GSGKSFDYSQSVRTTSQS-------------------VPEEQITAYLSKIQRGGH |
| pbphyb2 | ---G-GTGRSFDYSKSVRTTNQS-------------------VPEQQITAYLSKIQRGGH |
| sbphyB | ---G-ASGRSFDYSQSLRAPPTPS-------------------SEQQIAAYLSRIQRGGH |
| slphyb | ---G-ESGKSFDYSQSVKTYTSAES-----------------VPEQQITAYLSKIQRGGL |
| stphyb1 | ---G-ESGKFFDYSQSVKTTTQS-------------------VPERQITAYLTKIQRGGH |
| stphyb2 | ---G-ESGKFFDYSQSVKTTTQS-------------------VPERQITAYLTKIQRGGH |
| zmphyb1 | ---G-ASGRSFDYSQSLRAPPTPS-------------------SEQQIAAYLSRIQRGGH |
| zmphyb2 | ---G-ASGRSFDYSQSLRAPPTPS-------------------SEQQIAAYLSRIQRGGH |
| atphyc | -------ERLFDYSASINLNMPSSSCE---------------IPSSAVSTYLQKIQRGML |
| osphyc | -------QRHFDYSSSVGAANRSGA------------------TTSNVSAYLQNMQRGRF |
| sbphyc | -------QRNFDYSSSVSAAIRPS------------------VSTSTVSTYHQTMQRGLY |
| slphyc | -------ERVFNYTSSVDLNLLASSSD---------------VPSSTVKSYLQKVQRGGL |
| taphyc | -------QRHFDYSSSVSALNRSGA-----------------STSSAVSAYIQNMQRGRY |
| zmphyc1 | -------QRHFDYSSSVGAANRPSA------------------STSTVSTYLQNMQRGRY |
| zmphyc2 | -------QRHFDYSSSVGAANRPSA------------------STSTVSTYLQNMQRGRY |
| lephye | ---S-VSGKSFDYSKSVLFPPHEA-------------------NEEEITSYLSRIQRGGL |
| atphye | ---I-YTGKSFNYSKSVISPPNH-------------------VPDEHITAYLSNIQRGGL |
| inphye | ---R-ESGKSFDYSRSVIHAPQN-------------------VTEEEMTAYLSRIQRGGL |
| lephyf | -------EQQFDYSSSVNLSNSTSN-----------------VPSSTVSDYLQKMQRGSL |
| acvphy1 | -----SESGSFDYSQSVSAGKEG-------------------ISSQLVTAYLQRMQRGGL |
| acvphy2 | E-GD-TGGSSFDYMRSIEDARGSVLSER--------------VPAQAVTAYLQRMQRGGL |
| acvphy3 | AGAG-GSRAPFDYSKSGMDASSVTS-----------------VAPEAITAYLQRMQRGGL |
| apphy1 | ---G-DTGNSFDYTRSIDASRSSSES----------------IPPQAVTAYLQRMQRGGL |
| cpphy2 | ---G-DSGDSFDYSKSVGQSAES-------------------VPAGAVTAYLQRMQRGGL |
| mcphy1 | ---A-AVGGSFDYTKSVGASLNAGSEA---------------IPSSAVTAYLQRMQRGGI |
| mpphy1 | ---G-ESGDSFDYTKSINASKSTGES----------------VPAQAVTAYLQRMQRGGL |
| msphy1 | --SS-SGGDSFDYTKSVTASLNPTEP----------------LAAKSVTAYLQRMQRGSI |
| paphy1 | -------VHSFDYTKSIDISGDSSS-----------------VPSETVKAYLQRLQKEML |
| ppphy0 | ---G-DSGDSFDYSKSVSKSTAES------------------LPSGAVTAYLQRMQRGGL |
| ppphy1 | ---G-DSGDSFDYSKSVSKSTAES------------------LPSGAVTAYLQRMQRGGL |
| ppphy2 | ---G-DSGDSFDYSKSVHASKSTGE---N-------------VSAQAVTAYLQRMQRGGL |
| ppphy3 | ---G-VSGDNFDYSKSVSKSTAGS------------------LHTGAVTAYLQRMQRGGL |
| ppphy4 | ---G-DSGDSFDYSKSVHASKSTGE---N-------------VPALAVTAYLQRMQRGGL |
| psphy1 | ---G-ESGKSFDYTRSIQVHNRA-------------------VPEQQITAYLSRIQRGGR |
| smphy1 | ---G-ESGDSFDYSKSINATKSTGE---T-------------IPAQAVTAYLQRMQRGGL |

-continued

| Name/ SEQ ID No | Sequence |
|---|---|
| aphA | -----------------------------------MRIDVESQNINVTSLKEAPIHLSGQ |
| cph1 | -----------------------------------MATTVQLSDQSLRQLETLAIHTAHL |
| cwCph1 | ----------------------------------MISNSHITQDINLKRLEELQIHLWGK |
| npCph1 | -----------------------------------MEMNLQFPGINLISLKEAPIHISSQ |
| cwCph1a | --------------------------------------MRNLSLNDYKKYENFDFRYPGS |
| npCph1a | ---------------------------------MSQPENTTTQATALTNHDRKPIHIPGS |
| toCphA | -----------------------------------MVSEFQAQSINVNSLKEAAIHVCSQ |
| aphB | ---------------------------------MNINDITIPFQVDLSNCSKEPIHIPGL |
| atBphP1 | ------------------------------MQRERLEKVMSSHTPKLDSCGAEPIHIPGA |
| atBphP3 | ---------------------------------------MSSHTPKLDSCGAEPIHIPGA |
| avAphB | ---------------------------------MNINDITIPFHVDLSNCNKEPIHIPGL |
| chBphP1 | ---------------------------------MKIKDIVNRDLVNLQNCDQEPIHIPGS |
| chBphP2 | ---------------------------------------MSKQNYDSKFCGSLPISFVNQ |
| drbphp | --------------------------MSRDPLPFFPPLYLGGPEITTENCEREPIHIPGS |
| goBphP | -----------------------MDLHLTVQRSLAPEPGCSLEHAVMTSCDREPIHRPDA |
| krBphP | --------------------------MATGASMQPGSFTPGYGAVDLTTCEREPIHIPGA |
| mmBphP2 | -----------------------------------MVDTGSRSEPGLQGCESERLHLSGE |
| paBphP | -------------------------------------MTSI-TPVTLANCEDEPIHVPGA |
| pfBphP | ----------------------------------MNPQDKEAFEELLANCADEPIRFPGA |
| ppBphP1 | --------------------------------------MTYNPQVNLTNCDREPIQIPGS |
| ppBphP2 | ------------------------------------MTADNSLADAMERCAQEPIQVPGS |
| ppkBphP2 | -----------------------------MTGAFSIMTADNSLADAMERCAQEPIQVPGS |
| psBphP1 | ----------------------------------MSQLDKDAFEVLLANCADEPIQFPGA |
| psBphP2 | -----------------------------MIEHTLDANPDAALEAALAECAREPIRIPGA |
| pssBphP1 | ----------------------------------MSQLDKDAFEVLLANCADEPIQFPGA |
| pssBphP2 | ----------MEFTQLIKDMLD--------------AKPDAALEAALAECAREPIRVPGA |
| pstBphP1 | ----------------------------------MSQLDKDAFEVLLANCADEPIQFPGA |
| rcPpr | QIRMQNAGVPDRYWIFVRKLEDLRPPGPAPEAPAAHTASVTGEVVDFSVCEQEDIRRVGA |
| rlBphP | -------------------------------------MSGTHEPVDLTNCDREPIHQLGS |
| atBphP2 | -------------------------------------MASTDYHVDLTNCDREPIHIPGY |
| brBphP | --------------------------------MPVPLTTPAFGHATLANCEREQIHLAGS |
| rpBphP1N | -------------------------------VAGHASGSPAFGTADLSNCEREEIHLAGS |
| rpBphP2N | -----------------------------------MTEGSVARQPDLSTCDDEPIHIPGA |
| rpBphP3N | ----------------------MSSRSDPGQPMASATDPSGRLALDLTECDREPIHIPGA |
| rpBphP4N | ---------------------------MHSGLDNSAELRVSDFDPITLAGGTRTEVLPGA |
| rpBphP5N | ------------------------------MDEADSGGIVTARNVDLSSCDRELVQYPEA |
| rpBphP6N | ----------------------------------------MPRKVDLTSCDREPIHIPGS |
| rrBphP | ------------------------------------------MDTVHSTCDQEPIHVPGL |
| rsBphP1 | SSNGSPLLWQPGGYDRPPPPCRSLPHVCQNFVVRGCLMTISGGTFDPSICEMEPIATPGA |

-continued

| Name/<br>SEQ ID No | Sequence |
|---|---|
| rsBphP1a | -------------------------------------MTISGGTFDPSICEMEPIATPGA |
| toCphB | -------MLQLIYNNFIVSLSPENSPEN---------AAIAPFEVDLTNCDREPIHIPGS |
| xaBphP | -------------------------------------MNQPTEPLDMDVCAQEPIHIPGL |
| xcBphP | -------------------------------------MSTATNPLDLDVCAREPIHIPGL |
| anFPH1 | -------LMTTRFRHVVTDDGHAVITGR--------------TVDSFKACEDEPIHIPGA |
| bfFPH2 | ---------SSEYEARKISQRSQLIPSKSGPPGIAPGEPVSTEERTFFKCEDEPIHIPGA |
| chFPH1 | VDMG--DLVTHRFRHVSTEGGHMIITGR--------------EGETLQRCEDEPIHLPGA |
| cnFPH1 | AENPDEPAVTMRFEHVVTEEGHHIVAGR---------------EGRLRRCQDEPITTPGA |
| gmFPH1 | ADVP---LVTSRFTHVVTDDGHAVITGR---------------DGVLQRCEDEPIHTPGA |
| gzFPH1 | ADIS---HVTARFTHVVTDDGHAVITGR---------------DGVLQRCEDEPIHAPGA |
| ncFPH1 | LDALPETHFAPRFKHIVTNEGHAVITGR---------------DGQLQRCEDEPIHTPGA |
| ncFPH2 | LS------ETFEYALLADG-SHGVIQKA---------------RRAFTTCDEEPIHIPGA |
| umFPH1 | L-------TTTRFEHVKTDEGHMILTGR---------------GGKLARCEDEPIHIPGA |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | IQPFGCLLALDEK--------TFKVIAYSENAPELLTMASHA----VPSVGE-------- |
| asphya3 | IQTFGCLLALDEK--------SFNVIAFSENAPEMLTTVSHA----VPSVDD-------- |
| asphya4 | IQTFGCMLALDEK--------SFNVIAFSENAPEMLTTVSHA----VPSVDD-------- |
| atphya | IQPFGCLLALDEK--------TFKVIAYSENASELLTMASHA----VPSVGE-------- |
| cpphya | IQPFGCLLALDDK--------TFKVIAYSENAPEMLTMVSHA----VPSMGD-------- |
| cupphya | IQPFGCLLALDEK--------TFRVIAFSENAPDMLTMVSHA----VPSVGD-------- |
| gmphya | IQPFGCLLAIDEKNHM----QTCKVIAYSENEPEMLTMVSHA----VPSVGD-------- |
| lephya | IQPFGCLLALDEK--------TLKVIAFSENAPEMLTMVSHA----VPSVGE-------- |
| lsphya | IQPFGCLLALDEK--------TCKVVAYSENAPEMLTMVSHA----VPSVGD-------- |
| mgphya | IQPFGCLLAVDEK--------TFKVIAYSENAPEMLTMVSHA----VPSVGD-------- |
| ntphya | IQPFGCLLALDEK--------TFKVIAFSENAPEMLTMVSHA----VPSVGE-------- |
| omphya | IQQFGCLLALDEK--------TFRVIAYSENAPEMLTMVSHA----VPSVGD-------- |
| osphya | IQPFGCLLALDEK--------TFNVIALSENAPEMLTTVSHA----VPSVDD-------- |
| pcphya | IQPVGCLLAVDEK--------SFKIMAYSENAPEMLTMVSHA----VPSVGE-------- |
| psphya | IQPFGCLLALDEK--------TCKVVAYSENAPEMLTMVSHA----VPSVGD-------- |
| sbphya | IQPFGCLLALDEK--------SFRVIAFSENAPEMLTTVSHA----VPNVDD-------- |
| slphya1 | IQPFGCLLALDDK--------TFRVIAFSENAPEMLTMVSHA----VPSVGD-------- |
| slphya3 | IQPFGCLLALDDK--------TFRVIAFSENAPEMLTMVSHA----VPSVGD-------- |
| slphya4 | IQLFGCLLALDDK--------TFRVIAFSENAPEMLTMVSHA----VPSVGD-------- |
| stphya | IQPFGCLLALDEK--------TLKVIAFSENAPEMLTMVSHA----VPSVGE-------- |

-continued

| Name/ SEQ ID No | Sequence |
|---|---|
| taphya | IQSFGCLLALDEK--------SFNVIAFSENAPEMLTTVSHA----VPSVDD-------- |
| zmphya1 | IQPFGCLLALDEK--------SFRVIAFSENAPEMLTTVSHA----VPNVDD-------- |
| atphyb | IQPFGCMIAVDES--------SFRIIGYSENAREMLGIMPQS----VPTLEK-------- |
| atphyd | TQPFGCLIAVEES--------TFTIIGYSENAREMLGLMSQS----VPSIED-------- |
| gmphyb | IQPFGSMIAVDEP--------SFRILGYSDNARDMLGITPQS----VPSLDDKNDAAFAL |
| lephb1 | IQPFGCMIAVDEA--------SFRIIAYSENACEMLSLTPQS----VPSLDK-------- |
| lephb2 | IQPFGCTIAVEEA--------SFCVIAYSENACEMLDIMPQS----VPSLEK-------- |
| npphyB | IQPFGCMIAVDEA--------SFGVIAYSENACEMLSLTPQS----VPSLER-------- |
| ntphyb | IQPFGCMIAVDEA--------SFRVIAYSENACEMLSLTPQS----VPSLER-------- |
| osphyb | IQPFGCTLAVADD-------SSFRLLAYSENTADLLDLSPHH---SVPSLDS-------- |
| pbphyb1 | IQPFGCMIAVDEG--------SFRVIAYSENAKEMLGLTPQS----VPSLDK-------- |
| pbphyb2 | IQPFGCMIAADEQ--------SFRVIAYSENAKDMLGLTPQS----VPSLEK-------- |
| sbphyB | IQPFGCTLAVADD-------SSFRLLAFSENAADLLDLSPHH---SVPSLDS-------- |
| slphyb | IQPFGCMLAIDDL--------TYRIIAYSQNSVELLGFITTTTTAVPSLEA-------- |
| stphyb1 | IQPFGCMIAVDEA--------SFRVIAYSENACEMLSLTPQS----VPSLEK-------- |
| stphyb2 | IQPFGCMIAVDEA--------SFRVIAYSENACEMLSLTPQS----VPSLEK-------- |
| zmphyb1 | IQPFGCTLAVADD-------SSFRLLAFSENSPDLLDLSPHH---SVPSLDS-------- |
| zmphyb2 | IQPLGCTLAVADD-------SSFRLLAFSENAADLLDLSPHH---SVPSLDS-------- |
| atphyc | IQPFGCLIVVDEK--------NLKVIAFSENTQEMLGLIPHT----VPSMEQ-------- |
| osphyc | VQPFGCLLAVHPE--------TFALLAYSENAAEMLDLTPHA----VPTIDQ-------- |
| sbphyc | IQPFGCLLAVHPD--------TFTLLAYSENAPEMLDLTPHA----VPTIDQ-------- |
| slphyc | IQSFGCLIAIDEK--------NFKVIAYSENAPEMLDLTPHT----VPNIEQ-------- |
| taphyc | IQPFGCLLAIHPE--------SFALLAYSENAAEILDLTPHA----VPTIDQ-------- |
| zmphyc1 | IQPFGCLLAVHPD--------TFALLAYSENAPEMLDLTPHA----VPTIDQ-------- |
| zmphyc2 | IQPFGCLLAVHPD--------TFALLAYSENAPEMLDLTPHA----VPTIDQ-------- |
| lephye | VQPFGCMVAIEEP--------TFKIIGYSENCYDMLGFKP--------TKMK-------- |
| atphye | VQPFGCLIAVEEP--------SFRILGLSDNSSDFLGLLSLPSTSHSGEFDK-------- |
| inphye | IQPFGCMLAIEEP--------SFKIVGFSENCFDLLGLKSGV-----EPPER-------- |
| lephyf | IQPFGCMIAIDAQ--------NFAVIAYSENAPEMLDLTPHA----VPSIEQ-------- |
| acvphy1 | VQQFGCLIAVEEE--------TFRVLHMCE-APEMLDVATQA----VPTMGQ-------- |
| acvphy2 | IQPFGCMLALEEG--------SFRVIAYSENAAEMLDLMPQS----VPSVGVQ------- |
| acvphy3 | TQAFGCMLVVA----------GQKIVAFSENAPEMLEVAA-------------------- |
| apphy1 | IQPFGCMLAVEEE--------SFRVIAFSENALEMLDLMSQA----VPSVGMQ------- |
| cpphy2 | IQTFGCMVAVEEP--------NFCVIAYSENASEFLDLMPQA----VPSMGEM------- |
| mcphy1 | TQTFGCMLMVEEG--------SFRVRAFSENAGEMLDLVPQA----VPSMGQQ------- |
| mpphy1 | TQTFGCMLAVEEL--------TFRVLAYSENAPEMLDLMPQA----VPCVGQQ------- |
| msphy1 | IQSFGCMMAVEPG--------TFRIIAYSENVSEMLGVTPQS----VPTGDHQ------- |
| paphy1 | IQPFGCVLAVEEG--------SCAVVGYSENAPEMLDVVGGA--HAVPSIGGQQQEG--- |
| ppphy0 | TQSFGCMIAVEGT--------GFRVIAYSENAPEILDLVPQA----VPSVGEM------- |

-continued

| Name/ SEQ ID No | Sequence |
|---|---|
| ppphy1 | TQSFGCMIAVEGT--------GFRVIAYSENAPEILDLVPQA----VPSVGEM------- |
| ppphy2 | MQTFGCMLCVEES--------NFRVIAFSENAPEMLDLMPQA----VPSVGQQ------- |
| ppphy3 | TQSFGCMVAVEET--------GFRVIAYSENAPEFLDLMPQA----VPNIGEI------- |
| ppphy4 | VQTFGCMLCVDES--------SFRVIAYSENAPEMLDLMPQA----VPSVGQQ------- |
| psphy1 | IQPFGCVLAVEET--------TFRIIAYSEN-EEMLDLGAQS----VPSMEKPQQ----- |
| smphy1 | VQPFGCMLAVEEG--------SFRVIAFSDNAGEMLDLMPQS----VPSLGSGQQ----- |
| aphA | IQPHGVLLVLEEP--------GLKILQVSNNTWGILGINAEN------------------ |
| cph1 | IQPHGLVVVLQEP--------DLTISQISANCTGILGRSPED------------------ |
| cwCph1 | IQPHGVLFVLDES--------NLKIVQTSSNTKQFFGIIPQE------------------ |
| npCph1 | IQPHGVLLVLEEP--------ELKILQVSTNTLKVFGIAPEN------------------ |
| cwCph1a | IQPHGVLLVIDIK--------TFTIIQVSENTKRFLGVKPKT------------------ |
| npCph1a | IQPHGILLALST---------QLEIVQVSNNTQVYLCKAPED------------------ |
| toCphA | IQPHGVLLVLGEP--------ELNILQISSNTWSVFGILPED------------------ |
| aphB | IQPHGVLLVLQEV--------DLTILQVSNNTFNILGRHPEQ------------------ |
| atBphP1 | IQEHGALLVLSAR--------EFSVVQASDNLANYIGVD--------------------- |
| atBphP3 | IQEHGALLVLSAR--------EFSVVQASDNLANYIGVD--------------------- |
| avAphB | IQPHGVLLALQEI--------DLTILQVSNNTFNLLGRHPEQ------------------ |
| chBphP1 | IQPHGFLIAITKE--------TWEIRFCSENVIDFIGLSHKQ------------------ |
| chBphP2 | IQDYGFLLVCDP---------ALIVLQVSDNAEAFTRISYQS------------------ |
| drbphp | IQPHGALLTADGH--------SGEVLQMSLNAATFLGQEPTV------------------ |
| goBphP | IQPYGLLLVVDS-----------TSLKIIGGAGDIEGRLAPD------------------ |
| krBphP | IQPHGVLLAVERG--------DHRVVVASANAAGFFGRPLPE------------------ |
| mmBphP2 | IQPFGALLRLDP---------DGQVSHASANCGAVLGIPPEA------------------ |
| paBphP | IQPHGALVTLRA---------DGMVLAASENIQALLGFVASP------------------ |
| pfBphP | IQPHGLLLTLSEP--------DLSIIQISANVETLLARPAQE------------------ |
| ppBphP1 | IQPHGCLLACDAS--------ATVVLRHSVNAPQMLGV-AND------------------ |
| ppBphP2 | IQPHGFLLVLDAT--------DLRVLQASENVEHWLGLPARE------------------ |
| ppkBphP2 | IQPHGFLLVLDAT--------DLRVLQASENVEHWLGLPARE------------------ |
| psBphP1 | IQPHGLLFTLKEP--------ELTILQVSANVQSVLGKVPDQ------------------ |
| psBphP2 | IQPHGVLLSVAGD--------PLCIEQVSANCAKSLGLESAE------------------ |
| pssBphP1 | IQPHGLLFTLAEP--------ELTILQVSANVQTVLGHVPEQ------------------ |
| pssBphP2 | IQPHGVLLSVAGD--------PLCIEQVSANCATEFGMAADE------------------ |
| pstBphP1 | IQPHGLLFTLKEP--------ELTILQVSANVQSVLGKVPDQ------------------ |
| rcPpr | IQPWGAVLAVDPR--------DWTVCAASDNAQALLDCARPP------------------ |
| rlBphP | VQPFGFLLAVSS---------DWIVIRASANLAEFLGVTEAN------------------ |
| atBphP2 | IQPHGCLIACDNA--------MRMVLRHSENCGELLGLEGD------------------- |
| brBphP | IQPHGILLAVKEP--------DNVVIQASINAAEFLNTNS-------------------- |
| rpBphP1N | IQPHGALLVVSEP--------DHRIIQASANAAEFLNLGS-------------------- |

-continued

| Name/ SEQ ID No | Sequence |
|---|---|
| rpBphP2N | IQPHGLLLALAA---------DMTIVAGSDNLPELTGLAIGA------------------ |
| rpBphP3N | IQPHGYLFVVSET--------DLRIASVSANVEDLLRQPPAS------------------ |
| rpBphP4N | IQPHAALLALAPA--------DLTIVHAAGATASLLGAAAEL------------------ |
| rpBphP5N | IQPHGAMLTVDEQ--------SDRVLHASANCAAFIGKPPEA------------------ |
| rpBphP6N | IQPCGCLLACDAQ--------AVRITRISENAGAFFGRETP------------------- |
| rrBphP | VQPHGFLVVLDSK--------SGRIAQVTPGIEAVAGVVAQR------------------ |
| rsBphP1 | IQPHGALMTARAD--------SGRVAHASVNLGEILGLPAAS------------------ |
| rsBphP1a | IQPHGALMTARAD--------SGRVAHASVNLGEILGLPAAS------------------ |
| toCphB | IQPHGMLLALTEP--------ELTIVQVSRNTDEILGVAATE------------------ |
| xaBphP | IQPYGVLLVIEPA--------DGRIVQASSTAADLLGVPMDA------------------ |
| xcBphP | IQPYGVLLVIDPA--------DGRIVQASTTAADLLGVPMAA------------------ |
| anFPH1 | IQSFGALVAVREEPG-----EQMVVRIVSENSQDILGYSPND------------------ |
| bfFPH2 | IQQYGALIALRYNDQ-----GDLMVRIASENAFKILKYTPEQ------------------ |
| chFPH1 | VQGFGLLVALRDDPD-----GNLQVRIVSENSKRILGRTPKE------------------ |
| cnFPH1 | VQGFGVLMVLEEDYET----GNLEIRQVSEVNIFVIVMSKYQ----ETILRDTLEY---- |
| gmFPH1 | IQTFGALVALREEND-----GCFVARYISENSERMLGYTPKQ------------------ |
| gzFPH1 | VQTFGVLVALREEND-----GCFVARYVSENSVRMLGYTPKQ------------------ |
| ncFPH1 | VQGFGLMVVIQEERD-----GRFIVRFVSENSKRIIGYTPQE------------------ |
| ncFPH2 | IQSYGMLVALKLVDERVAGPSRYLPRICSENSAFVCHYQPSE------------------ |
| umFPH1 | VQSFGCMIVVRISPD-----GEMLVRQASENSAAILGMSPSY------------------ |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------HPVLGIGTDIRSLFTAPSASALQ---KALGFGD---VSLLNPILVHCK |
| asphya3 | ------------PPRLGIGTNVRSLFSDQGATALH---KALGFAD---VSLLNPILVQCK |
| asphya4 | ------------PPRLGIGTNVRSLFSDQGATALH---KALGFAD---VSLLNPILVQCK |
| atphya | ------------HPVLGIGTDIRSLFTAPSASALQ---KALGFGD---VSLLNPILVHCR |
| cpphya | ------------YPVLGIGTDVRTIFTAPSASALL---KALGFGE---VTLLNPILVHCK |
| cupphya | ------------LPVLGIGTDIRTIFTAPSGAALQ---KALGFGE---VSLLNPILVHCK |
| gmphya | ------------HPALGIGTDIKTLFTAPSVSGLQ---KALGCAD---VSLLNPILVHCK |
| lephya | ------------HPVLGIGTDIRTIFTGPSGAALQ---KALGFGE---VSLLNPVLVHCK |
| lsphya | ------------HPALGIGTDIRTVFTAPSASALQ---KALGFAE---VSLLNPILVHCK |
| mgphya | ------------HPLLGIGTDVRTIFTNPSAAALQ---KAMGYGE---VSLLNPILVHCK |
| ntphya | ------------LPALGIGTDIRTIFTGPSAAALQ---KALGFGE---VSLLNPVLVHCK |
| omphya | ------------HPLLGIGSDIRTIFTAPSAAALQ---KALGFGE---VSLLNPILVHCK |
| osphya | ------------PPKLRIGTNVRSLFTDPGTTALQ---KALGFAD---VSLLNPILVQCK |
| pcphya | ------------HPVLGIGTDVRTIFTAPSAAALQ---KAVGFTD---INLLNPILVHCK |

-continued

| Name/ SEQ ID No | Sequence |
|---|---|
| psphya | ------------HPALGIGTDIRTVFTAPSASALQ---KALGFAE---VSLLNPILVHCK |
| sbphya | ------------PPKLGIGTNVRSLFTDPGATALQ---KALGFAD---VSLLNPILVQCK |
| slphya1 | ------------LPVIGIGTDIRTIFTGPSASALQ---KALGFTD---VSLLNPILVHCK |
| slphya3 | ------------LPVIGIGTDIRTIFTDPSASALQ---KALGFTD---VSLLNPILVHCK |
| slphya4 | ------------LPVIGIGTNIRTIFTGPSASALQ---KALGFTD---VSLLNPILVHCK |
| stphya | ------------HPVLGIGIDIRTIFTGPSGAALQ---KALGFGE---VSLLNPVLVHCK |
| taphya | ------------PPRLDIGTNVRSLFTDQGAAALH---KALGFAD---VSLLNPILVQCK |
| zmphya1 | ------------PPKLGIGTNVRSLFTDPGATALQ---KALGFAD---VSLLNPILVQCK |
| atphyb | ------------PEILAMGTDVRSLFTSSSSILLE---RAFVARE---ITLLNPVWIHSK |
| atphyd | -----------KSEVLTIGTDLRSLFKSSSYLLLE---RAFVARE---ITLLNPIWIHSN |
| gmphyb | GPQSVPSLDDKNDAAFALGTDVRALFTHSSALLLE---KAFSARE---ISLMNPIWIHSR |
| lephb1 | ------------SEILTVGTDVRTLFTPSSSVLLE---RAFGARE---ITLLNPIWIHSK |
| lephb2 | ------------NEILKIGTDVRTLFSSSSSGLLE---GAFGARE---ITLLNPIWVHSK |
| npphyB | ------------PEILTVGTDVRTLFTPSSSVLLE---RAFGARE---ITLLNPIWIHSK |
| ntphyb | ------------PEILTVGTDVRTLFTPSSSVLLE---RAFGARE---ITLLNPIWIHSK |
| osphyb | ---------SAVPPPVSLGADARLLFAPSSAVLLE---RAFAARE---ISLLNPLWIHSR |
| pbphyb1 | ------------QEILSDGTDVRTLFRPSSSAMLE---KAFGARE---IILLNPIWIHSK |
| pbphyb2 | ------------QEILFVGADVRILFRPSSAVLLE---KAFGARE---ITLLNPIWIHSK |
| sbphyB | ----------AAPPPVSLGADARLLFSPSSAVLLE---RAFAARE---ISLLNPLWIHSR |
| slphyb | ----------VQQRIIAVGTDIRSLFMSSSCVLLE---KAFSARE---ITLLNPVWIHSK |
| stphyb1 | ------------CEILTIGTDVRTLFTPSSSVLLE---RAFGARE---ITLLNPIWIHSK |
| stphyb2 | ------------CEILTIGTDVRTLFTPSSSVLLE---RAFGARE---ITLLNPIWIHSK |
| zmphyb1 | ----------SAPPHVSLGADARLLFSPSSAVLLE---RAFAARE---ISLLNPIWIHSR |
| zmphyb2 | ----------VALPPVSLGADARLYFSPSSAVLLE---RAFAARE---ISLLNPLWIHSR |
| atphyc | ------------REALTIGTDVKSLFLSPGCSALE---KAVDFGE---ISILNPITLHCR |
| osphyc | ------------REALAVGTDVRTLFRSHSFVALQ---KAATFGD---VNLLNPILVHAR |
| sbphyc | ------------RDALAVGADVRTLFRSQSSVALH---KAATFGE---VNLLNPILVHAR |
| slphyc | ------------LEALTFGTDVATLFTSSGVSALQ---KAVNYSE---LNLLNPILVHSK |
| taphyc | ------------RDALAVGADVRTLFRSQSAVALH---KAAVFGE---VNLLNPILVHAR |
| zmphyc1 | ------------RDALGIGVDVRTLFRSQSSVALH---KAAAFGE---VNLLNPILVHAR |
| zmphyc2 | ------------RDALTIGADVRTLFRSQSSVALH---KAATFGE---VNLLNPILVHAR |
| lephye | --------------LGLIGVDARNLFTPSSGDSLA---KVMASRE---ISLLNPIWVHSR |
| atphye | -------------VKGLIGIDARTLFTPSSGASLS---KAASFTE---ISLLNPVLVHSR |
| inphye | --------------MSLIGIDARTLFTLSSRASLA---KAVASRE---ISLLNPIWVHSK |
| lephyf | ------------QEALTFGTDVRKLFRSSGASALE---KAVSFGE---LSLLNPILVHCK |
| acvphy1 | ------------YSRLCIGADVRTLLSPASASALD---RVIGVVD---VSMFNPITVQSR |
| acvphy2 | ------------VLVLGIGTDARTLFTYASAAALE---KASGAVD---VSMLNPITVHCR |
| acvphy3 | ----------------GLGTDLRMLFTQGSTAALD---QAVKEED---LSSVNPLVLQSC |

-continued

| Name/ SEQ ID No | Sequence |
|---|---|
| apphy1 | -------------EILGIGSDARSYFTPSSAAALE---KAVGAVD---VSMLNPITIHSK |
| cpphy2 | -------------DVLGIGTDIRTLFTPSSGAALE---KAAATQD---ISLLNPITVHCR |
| mcphy1 | -------------SLIAVGTDIRTLFTSASVSLLE---KAAMATD---VSVMNPVSLQSR |
| mpphy1 | -------------DVLGIGTDARTLFNSASAVALE---KAAGALD---VSMFNPISVQCK |
| msphy1 | -------------NAIGIGTDVRSLLSPSSVSVVE---KAVAAND---VSMMNPIAVYSL |
| paphy1 | --------GGGGGGLLRIGMDARTLFKPASAAALQ---KAATFAD---MHLVNPIFVRCN |
| ppphy0 | -------------DTLRIGTDVRTLFTASSVASLE---KAAEAQE---MSLLNPITVNCR |
| ppphy1 | -------------DTLRIGTDVRTLFTASSVASLE---KAAEAQE---MSLLNPITVNCR |
| ppphy2 | -------------EVLGIGTDARTLFTPSSAAALE---KCAGTVD---VTMLNPISVHCR |
| ppphy3 | -------------NTLGIGTDVRTLFTPSSAASLE---KAAETQE---ISLLNPITVYCR |
| ppphy4 | -------------EVLGIGTDARTLFTPSSAAALE---KCAGAVD---VTMLNPISVHCR |
| psphy1 | -------------DVLTIGTDVRTLFTAASAHSLE---KAAVAQE---ISLMNPIWVHCK |
| smphy1 | -------------DVLTIGTDARTLFT-AAASALE---KAAGAVD---LSMLNPIWVQSK |
| aphA | ----------------ILQKKLEDLLDSFQIERIQ---SGLSSGN---LEFINPTKIWIR |
| cph1 | ----------------LLGRTLGEVFDSFQIDPIQ---SRLTAGQ---ISSLNPSKLWAR |
| cwCph1 | ----------------IVNLTLDDIFDSFQIEQLK---IGLENNN---LDFINPTKLWAR |
| npCph1 | ----------------MLHKKLEDLLDPFQIERIK---TGLSGEN---LDFINPTKVWVR |
| cwCph1a | ----------------LLGKPLTYLMYLKQIKNIK----NILENN---NHFVDIIKLKKK |
| npCph1a | ----------------LLGRPLSYLLEPQPVEIVK----QCLVKK---VGSANAFKVLIN |
| toCphA | ----------------VLQKKLEDLLDPFQIERIK---AGILEGN---LDYINPTKIWVR |
| aphB | ----------------LLNQHLSCLLEAEQLSLLK---DCLAQED---LQIINPLEFIIK |
| atBphP1 | ----------------LPIGAVATEANLPFISVLS---AWYSGEE---SNFRYAWA---- |
| atBphP3 | ----------------LPIGAVATEANLPFISVLS---AWYSGEE---SNFRYAWA---- |
| avAphB | ----------------LLNQHLSCLLEAEQINLLQ---DCLTQED---LQIINPLEFIIK |
| chBphP1 | ----------------LLGKKITEIFDDIFFGKVI------QCKD---YAVGESKLIQGK |
| chBphP2 | ----------------FIDKNLKELLTADSFQLLQ--EKLSSKAQ---KRFTCTLEFYGG |
| drbphp | ----------------LRGQTLAALLPEQWPALQA--ALPPGCPD---ALQYRATLDWP- |
| goBphP | ----------------WLGRPLADILKIPESRLHD--EKRPSLSD----LRVAGL----- |
| krBphP | ----------------VLSSSLADLLGADLTERVR---GADLLDN---LDEVLHARLPGP |
| mmBphP2 | ----------------LLGQIPGPLLGGLVGLDEL---TPLGGFP---ILRTKAFTA--- |
| paBphP | ------------------GSYLTQEQVGPEVLRML---EEGLTGN---GPWSNSVETRI- |
| pfBphP | ----------------LIGQPLQSLIGDAHAAQVR---EALQQAA---LSDAPPLHFRL- |
| ppBphP1 | ----------------INGQKLHAVLGDEVTHTLR---NALARTR---DASRPALSFGVT |
| ppBphP2 | ----------------LIGCHFADLVHEGFDLHAH---LTRLPEDE--VFPFHIGDVRLR |
| ppkBphP2 | ----------------LIGCHFADLVHEGFDLHAH---LTRLPEDE--VFPFHIGDVRLR |
| psBphP1 | ----------------LAGQTLDCVLGAGWAEVIR---STSANDS---LVDVPRLLMSV- |
| psBphP2 | ----------------LLGQPLSILLSAAHSMLIN---QAYSQPA---MPNSDPIRLTV- |
| pssBphP1 | ----------------LLGKGLDCVLGAGWAEVIR---SASAHDS---FIDAQRLLMSI- |
| pssBphP2 | ----------------LLGKPLSWLLSPEQSALID---HAYGHPA---APHIDPIKLTI- |

-continued

| Name/ SEQ ID No | Sequence |
|---|---|
| pstBphP1 | ----------------LAGQTLDCVLGAGWAEVIR---STSANDS---LVDVPRLLMSV- |
| rcPpr | -----------------LGRPLGEVLDAGPLAALR---DWLPDRT----SRSWRGEMAR- |
| rlBphP | ----------------ALGRPVISLISPEALHAIR---NKLTTLR----GSDVVERIFGI |
| atBphP2 | ----------------LNGRTAEDVLGKKLVHDLR---NALTVTG----RTTRPAMLPAM |
| brBphP | ----------------VVGRPLRDLGGDLALQILP---HLNGPLH------LAPMTLRCT |
| rpBphP1N | ----------------VLGVPLAEIDGDLLIKILP---HLDPTAE------GMPVAVRCR |
| rpBphP2N | ----------------LIGRSAADVFDSETHNRLT---IALAEPG---AAVGAPIAVGFT |
| rpBphP3N | ----------------LLNVPIAHYLTAASAARLT---HALHGGD---PAAINPIRLDVV |
| rpBphP4N | ----------------LPGTAASTAFSSDQIARLQ----ALATAE---RWIERPQHAFTL |
| rpBphP5N | ----------------VIGAPIAAVLGAGWHELLG----SLHRMP----LDSGPVNIARE |
| rpBphP6N | ----------------RVGELLADYFGETEAHALR---NALAQSS----DPKRPALIFGW |
| rrBphP | ----------------LIGEPLERVLDPRSAQRCR---HRIARPE--YPHLIDPFPVRAP |
| rsBphP1 | ----------------VLGAPIGEVIGRVNEILLR-----EARRS----GSETPETIGSF |
| rsBphP1a | ----------------VLGAPIGEVIGRVNEILLR-----EARRS----GSETPETIGSF |
| toCphB | ----------------FINQPLSRLLDAQQIDFFR---NCLAQED---LTLVNPIELTIA |
| xaBphP | ----------------LLGTPYTQVLELPDAQPFA----VDDQPQ----HLLHADVRFPQ |
| xcBphP | ----------------LLGMPYTQVLTLPEAQPFA----VDDQPQ----HLMHAEVRFPQ |
| anFPH1 | --------------LFSLPTLCDIFPEDQADNFLD---HVDFVKEEGYDPSVDGPEVFIL |
| bfFPH2 | --------------LFSLNSFLDLLGVDVREDFIARV-DHALRAVTKNPSADTKLDIFSM |
| chFPH1 | --------------LFALESFTDILSEEQADNLLD---HIDFVKDEESNVTSNGPEVFTM |
| cnFPH1 | --------------LPESYGGSNSVEDSGPSVFLLSG-FGEPGSDAEEGVTEGGPETEVR |
| gmFPH1 | --------------LFQLKNFLDILTEEQQDNLLD---HIDFIRDEDADPAINGPEVFSL |
| gzFPH1 | --------------LFQLKNFLDILTEEQQDNLLD---HIDFIRDEDADPAINGPEVFSL |
| ncFPH1 | --------------LFRMNNFLDIFTDEQSENLLD---HIDFIRDEDSDPAINGPEVFSL |
| ncFPH2 | --------------LLSLDSFYQVMPNFQRHLFDVQ--LRHIRQGYDSTKKEQEPVVFAF |
| umFPH1 | --------------LFSLPTFLDLFDDDQADLLWD---NIDTLDQSSQDLAESGPTVFQL |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | T-----------------SAKPFYAIVHRVT-----------------GSIIVDFEPVKP |
| asphya3 | T-----------------SGKPFYAIVHRAT-----------------GCLVVDFEPVKP |
| asphya4 | T-----------------SGKPFYAIVHRAT-----------------GCLVVDFEPVKP |
| atphya | T-----------------SAKPFYAIIHRVT-----------------GSIIIDFEPVKP |
| cpphya | T-----------------SGKPFYAIVHRVT-----------------GSLIIDFEPVKP |
| cupphya | T-----------------SGKPFYAIVHRVT-----------------GSLIVDFEPVKP |
| gmphya | T-----------------SGKPFYAIVHRVT-----------------GSLIVDFEPVKP |

-continued

| Name/ SEQ ID No | Sequence |
|---|---|
| lephya | N-----------------SGKPFYAIVHRVT-----------------GSLILDFEPVKP |
| lsphya | T-----------------SGKPFYAIIHRVT-----------------GSLIIDFEPVKP |
| mgphya | T-----------------SGKPFYAIVHRVT-----------------GSLIIDFEPVKP |
| ntphya | T-----------------SGKPYYAIVHRVT-----------------GSLIIDFEPVKP |
| omphya | T-----------------SGKPFYAIIHRVT-----------------GSLIIDFEPVKP |
| osphya | T-----------------SGKPFYAIVHRAT-----------------GCLVVDFEPVKP |
| pcphya | T-----------------SGKPFYAIAHRVT-----------------GSLIIDFEPVKP |
| psphya | T-----------------SGKPFYAIIHRVT-----------------GSLIIDFEPVKP |
| sbphya | T-----------------SGKPFYAIVHRAT-----------------GCLVVDFEPVKP |
| slphya1 | N-----------------SGKPFYAIVHRVT-----------------RSLVIDFEPVKP |
| slphya3 | N-----------------SGKPFYAIVHRVT-----------------RSLVIDFEPVKP |
| slphya4 | N-----------------SGKPFYAIVHRVT-----------------RSLVIDFEPVKP |
| stphya | N-----------------SGKPFYAIVHRVT-----------------GSLIIDFEPVKP |
| taphya | T-----------------SGKPFYAIVHRAT-----------------GCLVVDFEPVNP |
| zmphya1 | T-----------------SGKPFYAIVHRAT-----------------GCLVVDFEPVKP |
| atphyb | N-----------------TGKPFYAILHRID-----------------VGVVIDLEPART |
| atphyd | N-----------------TGKPFYAILHRVD-----------------VGILIDLEPART |
| gmphyb | T-----------------SGKPFYGILHRID-----------------VGIVIDLEPART |
| lephb1 | N-----------------SGKPFYAILHRVD-----------------VGIVIDLEPART |
| lephb2 | N-----------------SGKPFYAILHRID-----------------VGIVIDLEPART |
| npphyB | N-----------------SGKPFYAILHRVD-----------------VGIVIDLEPAKT |
| ntphyb | N-----------------SGKPFYAILHRVD-----------------VGIVIDLEPART |
| osphyb | V-----------------SSNPFYAILHRID-----------------VGVVIDLEPART |
| pbphyb1 | N-----------------SGKPFYAILHRID-----------------VGIVIDLEPART |
| pbphyb2 | N-----------------SGKPFYAILHRID-----------------VGIVIDLEPART |
| sbphyB | V-----------------SSKPFYAILHRID-----------------VGVVIDLEPART |
| slphyb | A-----------------NGKPFYAILHRID-----------------VGIVIDLEPART |
| stphyb1 | N-----------------SGKPFYAILHRVD-----------------VGIVIDLEPART |
| stphyb2 | N-----------------SGKPFYAILHRVD-----------------VGIVIDLEPART |
| zmphyb1 | V-----------------SSKPFYAILHRID-----------------VGVVIDLEPART |
| zmphyb2 | A-----------------SSKPFYAILHRID-----------------VGVVIDLEPART |
| atphyc | S-----------------SSKPFYAILHRIE-----------------EGLVIDLEPVSP |
| osphyc | T-----------------SGKPFYAIMHRID-----------------VGLVIDLEPVNP |
| sbphyc | T-----------------SGKPFYAILHRID-----------------VGLVIDLEPVNP |
| slphyc | N-----------------SGKPFYAILHRIK-----------------VGLVLDLETVNL |
| taphyc | T-----------------SGKPFYAILHRID-----------------VGLVIDLEPVNP |
| zmphyc1 | T-----------------SGKPFYAILHRID-----------------VGLVIDLEPVNP |
| zmphyc2 | T-----------------SGKPFYAILHRID-----------------VGLVIDLEPFNP |
| lephye | T-----------------THKPFYAILHRID-----------------VGIVIDLEPANS |

-continued

| Name/ SEQ ID No | Sequence |
|---|---|
| atphye | T-----------------TQKPFYAILHRID-----------------AGIVMDLEPAKS |
| inphye | I-----------------NQKPFYAVLHRID-----------------VGIVIDLEPANS |
| lephyf | N-----------------SGKPFYAILHRIE-----------------VGLVIDLEPVDP |
| acvphy1 | S-----------------SGKPFYAILHRND-----------------VGLVIDLEPIRP |
| acvphy2 | S-----------------SSKPFNAIVHRID-----------------VGLVIDFEPVRP |
| acvphy3 | G----------------GSAKQFYAMLHRIEDV---------------AGVVIDLEPIEN |
| apphy1 | G-----------------SGKPFNAVVHRID-----------------VGLVIDFEPLRQ |
| cpphy2 | R-----------------SGKPLYAIAHRID-----------------IGIVIDFEAVKM |
| mcphy1 | A-----------------AKKPFFAVLHRID-----------------VGLVVDLEPVRP |
| mpphy1 | S-----------------SGKPFYAIVHRID-----------------AGLVIDIEPVRP |
| msphy1 | A-----------------TQKLFFAILHMND-----------------VGLVIDLEPISS |
| paphy1 | R-----------------SGKPFYAILNRID-----------------AGLVIDFEPVMP |
| ppphy0 | R-----------------SGKQLYAIAHRID-----------------IGIVIDFEAVKT |
| ppphy1 | R-----------------SGKQLYAIAHRID-----------------IGIVIDFEAVKT |
| ppphy2 | S-----------------SGKPFYAILHRID-----------------VGLVIDFEPVRS |
| ppphy3 | ------------------SKKPLYAIAHRID-----------------IGIVIDFEAVNM |
| ppphy4 | S-----------------SGKPFYAILHRID-----------------VGLVIDFEPVRP |
| psphy1 | N-----------------SRKPFYAIVHRID-----------------VGMVIDLEPLRT |
| smphy1 | T-----------------SAKPFYAIVHRID-----------------VGLVMDLEPVKA |
| aphA | KK--------------GDDYAVFDAVFHRNTE----------------GFLILELEPAIT |
| cph1 | VM--------------GDDFVIFDGVFHRNSD----------------GLLVCELEPAYT |
| cwCph1 | VD--------------GDNYVIFDGVFHRNGE----------------GFLILELEPSYF |
| npCph1 | KK--------------GDEYVVFDAIFHRNIE----------------GFLILELEPAIT |
| cwCph1a | K-----------------YDTQFKGIFHRVQ-----------------DSIIGELETFKL |
| npCph1a | T---------------LYGEIYFDAIAHRTE-----------------EAVILELEPTDS |
| toCphA | KK--------------GDEYVVFDAVFHRNPE----------------GLLILELEPAIS |
| aphB | S---------------HNESISFDVIAHRSN-----------------NLLILELEANLS |
| atBphP1 | -------------------EKKLDVSAHRSG-----------------TLVILEVEKAGV |
| atBphP3 | -------------------EKKLDVSAHRSG-----------------TLVILEVEKAGV |
| avAphB | S---------------HNQSINFDVIAHRSN-----------------GLLILELEANLS |
| chBphP1 | I-----------------EDKEFDFTAHQNE-----------------DVIILESEIHID |
| chBphP2 | ------------------VRTSFLTLIHVKE-----------------EYILFEFEPSDD |
| drbphp | ------------------AAGHLSLTVHRVG-----------------ELLILEFEPTEA |
| goBphP | ------------------KDETFSILRHAQG-----------------THLLIELEPVEA |
| krBphP | G------------GSAGADAVEADVVLHVSG-----------------ERLVVEIEPSPP |
| mmBphP2 | ------------------HGDALDLAVSPSG-----------------EGLLLEFEPTGD |
| paBphP | ------------------GEHLFDVIGHSYK-----------------EVFYLEFEIRTA |
| pfBphP | ------------------NGTAFEGLLHRHQ-----------------DVLILELEIHVE |

-continued

| Name/ SEQ ID No | Sequence |
|---|---|
| ppBphP1 | L----------------PNGAAVDIAAHLYK-----------------GTAILEFEPAGA |
| ppBphP2 | QG--------------APISALLHMLVHCHD-----------------QVLIAEFEPPRL |
| ppkBphP2 | QG--------------APISALLHMLVHCHD-----------------QVLIAEFEPPRL |
| psBphP1 | ------------------EGVEFEALLHRSQ-----------------EALVLELEIQDK |
| psBphP2 | ------------------RAVDYNASLSRAG-----------------DVLIIELEPFVE |
| pssBphP1 | ------------------NGIEFEALLHRHQ-----------------GVLVLELEIQGK |
| pssBphP2 | ------------------GTAHYSASLQRAD-----------------DVLIIELEPFVE |
| pstBphP1 | ------------------EGVEFEALLHRSQ-----------------EALVLELEIQDK |
| rcPpr | -------------------GRRIDIRAHRSG-----------------GCVVLDLEPLTA |
| rlBphP | ALT--------------PDQNSFDLAVHLNE-----------------GQVIIEGERCQE |
| atBphP2 | ET---------------SDGRSFDISLHRYK-----------------STTIIEFEPSGS |
| brBphP | VG---------------SPPRRVDCTVHRPS----------------NGGLIVELEPATK |
| rpBphP1N | IG---------------NPSTEYDGLMHRPP----------------EGGLIIELERAGP |
| rpBphP2N | M----------------RKDAGFVGSWHRHD-----------------QLVFLELEPPQR |
| rpBphP3N | TP---------------DGERAFNGILHRHD-----------------SIVILELEPRDE |
| rpBphP4N | NAP---------------DATPIDVIVHHAS-----------------GLLVVELDPRRE |
| rpBphP5N | SFL--------------GSDQGWHLFAHRCG-----------------GLIILEFEKAEP |
| rpBphP6N | RDG--------------LTGRTFDISLHRHD-----------------GTSIVEFEPAAA |
| rrBphP | ------------------GGQSFSAVAHATD-----------------QADLVELWSDDQ |
| rsBphP1 | R----------------RSDGQLLHLHAFQS----------------GDYMCLDIEPVRD |
| rsBphP1a | R----------------RSDGQLLHLHAFQS----------------GDYMCLDIEPVRD |
| toCphB | V---------------GENARAFDGIIHRSD-----------------RLLILELEPVLH |
| xaBphP | RS--------------APTDHPWVAAWHLYP-----------------EQWLVEIEPRDA |
| xcBphP | RA--------------TPPDSAWVAAWHLYP-----------------QQWLVEMEPRDA |
| anFPH1 | TVN-----------QPNGSTIRVWCAIHTNPALN--------------GLVICEFELEDD |
| bfFPH2 | SV------------VAHTGLVNLWCAIHISKGTD--------------DLIICEFEPFSD |
| chFPH1 | SIK----------IAGHTRTRKLWCAIHTNEANP--------------GLVICEFELEED |
| cnFPH1 | STA--------SNAGGKRKEWTCWVAAHRPEHRGWNKVDEIGEPIPPPDWIILEFELERD |
| gmFPH1 | SIR-----------SPKRKSTKLWCAIHINPAHP--------------DLIICEFELDED |
| gzFPH1 | SIR-----------PPKCKSTKLWCAIHINPAHP--------------DLIICEFELDDD |
| ncFPH1 | SIR----------LPKAKTSVRLWCAIHVHPSRP--------------ELTICEFELDDD |
| ncFPH2 | SF-----------SDPDGRLIPCWCAAHYLGGDT--------------DLFICEFELQDY |
| umFPH1 | RGYDMASYDERVSRGVQRNRWNTWCGAHIPDRRNDGQAE---------LTVVLEFELVDD |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | YEVPM------------------------------------------------------- |

-continued

| Name/ SEQ ID No | Sequence |
|---|---|
| asphya3 | TEFPA------------------------------------------------------- |
| asphya4 | TEFPA------------------------------------------------------- |
| atphya | YEVPM------------------------------------------------------- |
| cpphya | YEGPV------------------------------------------------------- |
| cupphya | YEAPM------------------------------------------------------- |
| gmphya | YEVPM------------------------------------------------------- |
| lephya | YEVPM------------------------------------------------------- |
| lsphya | YEVPM------------------------------------------------------- |
| mgphya | YEVPM------------------------------------------------------- |
| ntphya | YEVPM------------------------------------------------------- |
| omphya | HEVPM------------------------------------------------------- |
| osphya | TEFPA------------------------------------------------------- |
| pcphya | YEVPM------------------------------------------------------- |
| psphya | YEVPM------------------------------------------------------- |
| sbphya | TEFPA------------------------------------------------------- |
| slphya1 | YEVPM------------------------------------------------------- |
| slphya3 | YEVPM------------------------------------------------------- |
| slphya4 | YEVPM------------------------------------------------------- |
| stphya | YEVPM------------------------------------------------------- |
| taphya | TEFPA------------------------------------------------------- |
| zmphya1 | TEFPA------------------------------------------------------- |
| atphyb | EDPAL------------------------------------------------------- |
| atphyd | EDPAL------------------------------------------------------- |
| gmphyb | EDPAL------------------------------------------------------- |
| lephb1 | EDPAL------------------------------------------------------- |
| lephb2 | EDPAL------------------------------------------------------- |
| npphyB | EDPAL------------------------------------------------------- |
| ntphyb | EDPAL------------------------------------------------------- |
| osphyb | EDPAL------------------------------------------------------- |
| pbphyb1 | EDPAL------------------------------------------------------- |
| pbphyb2 | EDPAL------------------------------------------------------- |
| sbphyB | EDPAL------------------------------------------------------- |
| slphyb | EDPAL------------------------------------------------------- |
| stphyb1 | EDPAL------------------------------------------------------- |
| stphyb2 | EDPAL------------------------------------------------------- |
| zmphyb1 | EDPAL------------------------------------------------------- |
| zmphyb2 | EDPAL------------------------------------------------------- |
| atphyc | DEVPV------------------------------------------------------- |

-continued

| Name/ SEQ ID No | Sequence |
|---|---|
| osphyc | VDLPV------------------------------------------------------- |
| sbphyc | VDVPV------------------------------------------------------- |
| slphyc | AETLV------------------------------------------------------- |
| taphyc | ADVPV------------------------------------------------------- |
| zmphyc1 | ADVPV------------------------------------------------------- |
| zmphyc2 | ADVPV------------------------------------------------------- |
| lephye | SDPAL------------------------------------------------------- |
| atphye | GDPAL------------------------------------------------------- |
| inphye | ADPAL------------------------------------------------------- |
| lephyf | HEVPV------------------------------------------------------- |
| acvphy1 | DDASI------------------------------------------------------- |
| acvphy2 | ADVAVW------------------------------------------------------ |
| acvphy3 | GVVEK------------------------------------------------------- |
| apphy1 | ADITVS------------------------------------------------------ |
| cpphy2 | NDVSV------------------------------------------------------- |
| mcphy1 | SDPNV------------------------------------------------------- |
| mpphy1 | SDPSV------------------------------------------------------- |
| msphy1 | SSDSAM------------------------------------------------------ |
| paphy1 | SDVPV------------------------------------------------------- |
| ppphy0 | DDHLV------------------------------------------------------- |
| ppphy1 | DDHLV------------------------------------------------------- |
| ppphy2 | NDAIV------------------------------------------------------- |
| ppphy3 | NDVTI------------------------------------------------------- |
| ppphy4 | NDAVV------------------------------------------------------- |
| psphy1 | GDAFM------------------------------------------------------- |
| smphy1 | SDTRVG------------------------------------------------------ |
| aphA | QENIP------------------------------------------------------- |
| cph1 | SDNLP------------------------------------------------------- |
| cwCph1 | SRKYP------------------------------------------------------- |
| npCph1 | QENIP------------------------------------------------------- |
| cwCph1a | NDNNK------------------------------------------------------- |
| npCph1a | EFEVS------------------------------------------------------- |
| toCphA | QENIP------------------------------------------------------- |
| aphB | DKTHS------------------------------------------------------- |
| atBphP1 | GESAE------------------------------------------------------- |
| atBphP3 | GESAE------------------------------------------------------- |
| avAphB | DKNYS------------------------------------------------------- |
| chBphP1 | NTPKN------------------------------------------------------- |
| chBphP2 | TDIKG------------------------------------------------------- |

-continued

| Name/ SEQ ID No | Sequence |
|---|---|
| drbphp | WDSTG------------------------------------------------------- |
| goBphP | HNLLT------------------------------------------------------- |
| krBphP | HTAPV------------------------------------------------------- |
| mmBphP2 | FSGTH------------------------------------------------------- |
| paBphP | DTLSI------------------------------------------------------- |
| pfBphP | NFQPR------------------------------------------------------- |
| ppBphP1 | SIAEP------------------------------------------------------- |
| ppBphP2 | PADLV------------------------------------------------------- |
| ppkBphP2 | PADLV------------------------------------------------------- |
| psBphP1 | AAQAI------------------------------------------------------- |
| psBphP2 | AAHEQ------------------------------------------------------- |
| pssBphP1 | DAQSV------------------------------------------------------- |
| pssBphP2 | TGHGQ------------------------------------------------------- |
| pstBphP1 | AAQAI------------------------------------------------------- |
| rcPpr | RPGEA------------------------------------------------------- |
| rlBphP | DRHDA------------------------------------------------------- |
| atBphP2 | DAQPL------------------------------------------------------- |
| brBphP | TTNVA------------------------------------------------------- |
| rpBphP1N | PIDLS------------------------------------------------------- |
| rpBphP2N | DVAEP------------------------------------------------------- |
| rpBphP3N | SRYTN------------------------------------------------------- |
| rpBphP4N | PAPEN------------------------------------------------------- |
| rpBphP5N | EAAGT------------------------------------------------------- |
| rpBphP6N | DQADNP------------------------------------------------------ |
| rrBphP | ETTVE------------------------------------------------------- |
| rsBphP1 | EDGRL------------------------------------------------------- |
| rsBphP1a | EDGRL------------------------------------------------------- |
| toCphB | QKNYT------------------------------------------------------- |
| xaBphP | RLMDV------------------------------------------------------- |
| xcBphP | RLLDV------------------------------------------------------- |
| anFPH1 | HVNPL---------------------------------------------TSSGHISPAV |
| bfFPH2 | EMFFPDEP------------------------------------------HNTKNDLPKF |
| chFPH1 | PLYPL---------------------------------------------VPPNNNTPDL |
| cnFPH1 | VYNPLVHPSENAETSTAAANSNARSLSPDSTAASVSASGSNSNSNTLSASTRSGERTLDS |
| gmFPH1 | AEYPL---------------------------------------------RPVDELTPDT |
| gzFPH1 | VEYPL---------------------------------------------RPADEMTPDT |
| ncFPH1 | HDYPL---------------------------------------------RPPEEDLPDI |
| ncFPH2 | SMHPL---------------------------------------------ATPAMSDPGN |

-continued

| Name/<br>SEQ ID No | Sequence |
|---|---|
| umFPH1 | LTNPISTSSPPA--------------------------------------TPLDDRESHS |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |

-continued

| Name/ SEQ ID No | Sequence |
|---|---|
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |

-continued

| Name/ SEQ ID No | Sequence |
|---|---|
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | PTNT----------------------------LDVVPTIEQMAGSTITINQPLRVLRRAR |
| bfFPH2 | PTRT----------------------------IDNDTVLEERLKSISSGSQPLRVLQIAK |

-continued

| Name/ SEQ ID No | Sequence |
|---|---|
| chFPH1 | PEDT----------------------------LSSQPTADEFLESTEIKSKPLRILRSAR |
| cnFPH1 | LTSTLAGGRAGVSAGLGPGTASSDASPGDLGSSASDFTSVPKQEARMGLDGLEMHIPLEK |
| gmFPH1 | PHDT----------------------------LQSNPTLEEIEDSTEVLSKPLRILRSAR |
| gzFPH1 | PHDT----------------------------LQSNPTLEEIEDSTEVLSKPLRILRSAR |
| ncFPH1 | PEDT----------------------------LQSNPTTEELTESTAISSKPLRVLRSAR |
| ncFPH2 | PIDT----------------------------LGSDHLDFATACSIQSKVQPAFPNPELI |
| umFPH1 | GNGPGLGLAAGWIRPDQPTSSRQDSSPVTIG-TVLSSSNASSVGPRAGLEGLAYTPSPNE |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | -----------------------------------------------TAAGALQSYKLAA |
| asphya3 | -----------------------------------------------TAAGALQSYKLAA |
| asphya4 | -----------------------------------------------TAAGALQSYKLAA |
| atphya | -----------------------------------------------TAAGALQSYKLAA |
| cpphya | -----------------------------------------------TAAGALQSYKLAA |
| cupphya | -----------------------------------------------TAAGALQSYKLAA |
| gmphya | -----------------------------------------------TAAGALQSYKLAA |
| lephya | -----------------------------------------------TAAGALQSYKLAA |
| lsphya | -----------------------------------------------TAAGALQSYKLAA |
| mgphya | -----------------------------------------------TAAGALQSYKLAA |
| ntphya | -----------------------------------------------TAAGALQSYKLAA |
| omphya | -----------------------------------------------TAAGALQSYKLAA |
| osphya | -----------------------------------------------TAAGALQSYKLAA |
| pcphya | -----------------------------------------------TAAGALQSYKLAS |
| psphya | -----------------------------------------------TAAGALQSYKLAA |
| sbphya | -----------------------------------------------TAAGALQSYKLAA |
| slphya1 | -----------------------------------------------TAAGALQSYKLAA |
| slphya3 | -----------------------------------------------TAAGALQSYKLAA |
| slphya4 | -----------------------------------------------TAAGALQSYKLAA |
| stphya | -----------------------------------------------TAAGALQSYKLAA |
| taphya | -----------------------------------------------TAAGALQSYKLAA |
| zmphya1 | -----------------------------------------------TAAGALQSYKLAA |
| atphyb | -----------------------------------------------SIAGAVQSQKLAV |
| atphyd | -----------------------------------------------SIAGAVQSQKLAV |
| gmphyb | -----------------------------------------------SIAGAVQSQEALV |
| lephb1 | -----------------------------------------------SIAGAVQSQKLAV |

-continued

| Name/ SEQ ID No | Sequence |
|---|---|
| lephb2 | -----------------------------------------------SIAGAVQSQKLAV |
| npphyB | -----------------------------------------------SIAGAVQSQKLAV |
| ntphyb | -----------------------------------------------SIAGAVQSQKLAV |
| osphyb | -----------------------------------------------SIAGAVQSQKLVV |
| pbphyb1 | -----------------------------------------------SIAGAVQSQKLAV |
| pbphyb2 | -----------------------------------------------SIAGAVQSQKLAV |
| sbphyB | -----------------------------------------------SIAGAVQSQKLAV |
| slphyb | -----------------------------------------------SIAGAVQSQKLAV |
| stphyb1 | -----------------------------------------------SIAGAVQSQKLRS |
| stphyb2 | -----------------------------------------------SIAGAVQSQKLAV |
| zmphyb1 | -----------------------------------------------SIAGAVQSQKLAV |
| zmphyb2 | -----------------------------------------------SIAGAVQSQKLAV |
| atphyc | -----------------------------------------------TAAGALRSYKLAA |
| osphyc | -----------------------------------------------TATGAIKSYKLAA |
| sbphyc | -----------------------------------------------TAAGALKSYKLAA |
| slphyc | -----------------------------------------------GVSGALMSYKLAA |
| taphyc | -----------------------------------------------TAAGALKSYKLAA |
| zmphyc1 | -----------------------------------------------TAAGALKSYKLAA |
| zmphyc2 | -----------------------------------------------TAAGALKSYKLAA |
| lephye | -----------------------------------------------LLAGAVQSQKLAV |
| atphye | -----------------------------------------------TLAGAVQSQKLAV |
| inphye | -----------------------------------------------LLAGAVQSQKLAV |
| lephyf | -----------------------------------------------TTAGAIKSYKLAA |
| acvphy1 | ------------------------------------------------TGGALQSHKLAA |
| acvphy2 | -----------------------------------------------AAAGALQSHKLAA |
| acvphy3 | ----------------------------------------------------KSSAEMAV |
| apphy1 | -----------------------------------------------AAG-ALQSHKLAA |
| cpphy2 | -----------------------------------------------SAAGALQSHKLAA |
| mcphy1 | -----------------------------------------------SAAGAMQSHKLAA |
| mpphy1 | -----------------------------------------------SAAGALQSHKLAA |
| msphy1 | -----------------------------------------------FSAGAVQSHKLAA |
| paphy1 | -----------------------------------------------SAAGALQSYKLAA |
| ppphy0 | -----------------------------------------------SAAGALQSHKLAA |
| ppphy1 | -----------------------------------------------SAAGALQSHKLAA |
| ppphy2 | -----------------------------------------------SSAGVLQSHKLAA |
| ppphy3 | -----------------------------------------------SADGALQSHKLAA |
| ppphy4 | -----------------------------------------------SSAGALQSHKLAA |
| psphy1 | -----------------------------------------------SAAGAVQSQKLAV |
| smphy1 | -----------------------------------------------SAAGALQSHKLAA |

-continued

| Name/ SEQ ID No | Sequence |
|---|---|
| aphA | ------------------------------------------------------FLSFYH |
| cph1 | ------------------------------------------------------FLGFYH |
| cwCph1 | ------------------------------------------------------LFKFLS |
| npCph1 | ------------------------------------------------------FLSFYH |
| cwCph1a | ------------------------------------------------------NIDYYK |
| npCph1a | ------------------------------------------------------FLNFHS |
| toCphA | ------------------------------------------------------FLSFYH |
| aphB | ------------------------------------------------------FFRFYH |
| atBphP1 | --------------------------------------------------------KLMG |
| atBphP3 | --------------------------------------------------------KLMG |
| avAphB | ------------------------------------------------------FFRFYH |
| chBphP1 | --------------------------------------------------------DLFD |
| chBphP2 | ------------------------------------------------------FREVYQ |
| drbphp | ----------------------------------------------------------PH |
| goBphP | -------------------------------------------------------WDIFG |
| krBphP | ---------------------------------------------------------SYR |
| mmBphP2 | -----------------------------------------------------SLKLKSL |
| paBphP | -------------------------------------------------------TSFTL |
| pfBphP | -----------------------------------------------------NVAGTET |
| ppBphP1 | ----------------------------------------------------------IE |
| ppBphP2 | -----------------------------------------------------GQGDYYP |
| ppkBphP2 | -----------------------------------------------------GQGDYYP |
| psBphP1 | -----------------------------------------------------SYSERTG |
| psBphP2 | ----------------------------------------------------------SR |
| pssBphP1 | -----------------------------------------------------SYSERTG |
| pssBphP2 | ----------------------------------------------------------SR |
| pstBphP1 | -----------------------------------------------------SYSERTG |
| rcPpr | -----------------------------------------------------PVCSLLA |
| rlBphP | ---------------------------------------------------------ASL |
| atBphP2 | -----------------------------------------------------------G |
| brBphP | -----------------------------------------------------------P |
| rpBphP1N | -----------------------------------------------------------G |
| rpBphP2N | -------------------------------------------------------QAFFR |
| rpBphP3N | --------------------------------------------------------EFFR |
| rpBphP4N | ---------------------------------------------------------SLA |
| rpBphP5N | ------------------------------------------------------TSNLYS |
| rpBphP6N | ----------------------------------------------------------LR |
| rrBphP | --------------------------------------------------------GVFG |

-continued

| Name/ SEQ ID No | Sequence |
|---|---|
| rsBphP1 | ---------------------------------------------------------PPG |
| rsBphP1a | ---------------------------------------------------------PPG |
| toCphB | ------------------------------------------------------FFNFYH |
| xaBphP | ---------------------------------------------------------TLR |
| xcBphP | ---------------------------------------------------------TLR |
| anFPH1 | RRKGEAA------------------------------------------------AMEVF |
| bfFPH2 | RKGRHAV-----------------------------------------------GSLEVF |
| chFPH1 | KRKGEAA------------------------------------------------AMEVF |
| cnFPH1 | ILESTTNHASPLRALERMRGTTVNASNEARSRGRGRGRARGGRQRPIRTESGGTGTMDIF |
| gmFPH1 | KRRGEQG------------------------------------------------AMQVF |
| gzFPH1 | KRRGEQG------------------------------------------------AMQVF |
| ncFPH1 | RRRGEAG------------------------------------------------AMQVF |
| ncFPH2 | SKGFDPST----------------------------------------------SSVEVI |
| umFPH1 | LHESTHAIHKPLKALSRMRRNAEIKS--------QTRSRRPAVLPNAGGADGTGGILDLF |
| aphC | -------------------------------------------MSPTAKPNSQVSLNQES |
| cph2 | ---------------------------------------------------MNPNRSLED |
| npCph2a1 | --------------------------------------------MTSNPEQNFLYSQEES |
| npCph2a2 | ----------------------------------------------MEFLTNQVSQTQEI |
| npCph2b | ------------------------------------------MTSTDKPNGLQQSLEQES |
| arphyA | KAITRLQS--LPSGSMERLCDTMVQEVFELTGYDRVMAYKFHEDD--HGEVVSEVTKPG- |
| asphya3 | KAISKIQS--LPGGSMEVLCNTVVKEVFDLTGYDRVMAYKFHEDD--HGEVFSEITKPG- |
| asphya4 | KAISKIQS--LPGGSMEVLCNTVVKEVFDLTGYDRVMAYKFHEDD--HGEVFAEITKPG- |
| atphya | KAITRLQS--LPSGSMERLCDTMVQEVFELTGYDRVMAYKFHEDD--HGEVVSEVTKPG- |
| cpphya | KAITRLQS--LPSGSMARLCDTMVQEVFELTGYDRVMAYKFHDDD--HGEVISEVAKPG- |
| cupphya | KAIARLQS--LPSGSLERFCDTIVQEVFELTGYDRVMAYKFHDDD--HGEVVSEITKPG- |
| gmphya | KAITRLQS--LPSGNMERLCDTMVQEVFELTGYDRVMAYKFHEDD--HGEVIREITKPC- |
| lephya | KAITRLQS--LPSGSMERLCDTMVQEVFELTGYDRVMGYKFHEDD--HGEVVSEITKPG- |
| lsphya | KAITRLQS--LASGSMERLCDTMVQEVFELTGYDRVMAYKFHEDD--HGEVIAEIAKPG- |
| mgphya | KAITRLQS--LPSGNMRILCDAMVQEVFELTGYDRVMVYKFHDDD--HGEVFSELTKPG- |
| ntphya | KAITRLQA--LPSGSMERLCDTMVQEVFELTGYDRVMTYKFHDDD--HGEVVAEITKPG- |
| omphya | KAIACLQA--LPGGSIERLCDTMVQQVFELTGYDRVMIYKFHEDD--HGEVFTEITKPG- |
| osphya | KAISKIQS--LPGGSMEVLCNTVVKELFDLTGYDRVMAYKFHEDD--HGEVFAEITKPG- |
| pcphya | KAVNRLQA--LPGGSMERLCDTMVQEVFELTGYDRVMAYKFHDDD--HGEVTAEVTKPG- |
| psphya | KAITRLQS--LASGSMERLCDTMVQEVFELTGYDRVMAYKFHEDD--HGEVIAEIAKPG- |
| sbphya | KAISKIQS--LPGGSMEALCNTVVKEVFELTGYDRVMAYKFHEDE--HGEVFAEITKPG- |
| slphya1 | KAITRLQS--LPSGNMVRLVDTMVQEVFELTGYDRVMAYKFHDDD--HGEVVSEVTKPN- |
| slphya3 | KAITRLQS--LPSGNMDRLVDTMVQEVFELTGYDRVMAYKFHDDD--HGEVVSEVTKPN- |
| slphya4 | KAITRLQS--LPSGNMDRLVDTMVQEVFELTGYDRVMAYKFHDDD--HGEVVSEVTKPN- |
| stphya | KAITRLQS--LPSGSMERLCDTMVQEVFELTGYDRVMGYKFHDDD--HGEVVSEITKPG- |

-continued

| Name/ SEQ ID No | Sequence |
|---|---|
| taphya | KAISKIQA--LPGGSMELLCNTVVKEVFDLTGYDRVMAYKFHEDN--HGEVFAEITKPG- |
| zmphya1 | KAISKIQS--LPGGSMQALCNTVVKEVFDLTGYDRVMAYKFHEDE--HGEVFAEITKPG- |
| atphyb | RAISQLQA--LPGGDIKLLCDTVVESVRDLTGYDRVMVYKFHEDE--HGEVVAESKRDD- |
| atphyd | RAISHLQS--LPSGDIKLLCDTVVESVRDLTGYDRVMVYKFHEDE--HGEVVAESKRND- |
| gmphyb | RAISQLQS--LPSADVKLLCDTVVESVRELTGYDRVMVYKFHEDE--HGEVVSESKRPD- |
| lephb1 | RAISHLQS--LPGGDIKLLCDTVVESVRELTGYDRVMVYKFHEDE--HGEVVAESKRSD- |
| lephb2 | RAISLLQS--LPGGDIDLLCDTVVKSVRELTGYDRVMVYKFHDDE--HGEVVAESRRSD- |
| npphyB | RAISHLQS--LPGGDVKILCDTVVESVRELTGYDRVMVYKFHEDE--HGEVVAESKRPD- |
| ntphyb | RAISHLQS--LPGGDVKLLCDTVVESVRELTGYDRVMVYKFHEDE--HGEVVAESKIPD- |
| osphyb | RAISRLQA--LPGGDVKLLCDTVVEHVRELTGYDRVMVYRFHEDE--HGEVVAESRRSN- |
| pbphyb1 | RSISQLQS--LPGGDIKLLCDTVVESVRELTGYDRVMVYKFHEDE--HGEVVAENKRAD- |
| pbphyb2 | RAISQLQS--LPGGDIKLLCDTVVDSVRELTGYDRVMVYKFHEDE--HGEVVAENKRVD- |
| sbphyB | RAISRLQA--LPGGDIKLLCDTVVEHVRELTGYDRVMVYRFHEDE--HGEVVAESRRDN- |
| slphyb | RAISQLQS--LPGGDVKLLCDTVVESVRQLAAYDRVMVYKFHEDE--HGEVVAESKRAD- |
| stphyb1 | EGLFLICN-HFLVGTLKLLCDTVVESVRELTGYDRVMVYKFHEDE--HGEVVAESKRSD- |
| stphyb2 | RAISHLQS--LPGGDIKLLCDTVVESVRELTGYDRVMVYKFHEDE--HGEVVAESKRSD- |
| zmphyb1 | RAISRLQA--LPGGDVKLLCDTVVEHVRELTGYDRVMVYRFHEDE--HGEVVAESRRDN- |
| zmphyb2 | RAISRLQA--LPGGDVKLLCDTVVEHVRELTGYDRVMVYKFHEDE--HGEVVAESRRDN- |
| atphyc | KSISRLQA--LPSGNMLLLCDALVKEVSELTGYDRVMVYKFHEDG--HGEVIAECCRED- |
| osphyc | RAIARLQS--LPSGNLSLLCDVLVREVSELTGYDRVMAYKFHEDE--HGEVIAECKRSD- |
| sbphyc | KAISRLQS--LPSGNLSLLCDVLVREVSELTGYDRVMAYKFHEDE--HGEVISECRRSD- |
| slphyc | KAISKLQS--LPSQNIPLLCDVLVKEVRELTGYDRVMVYKFHDDQ--HGEVIGESHSPS- |
| taphyc | KAISRLQS--LPSGNLSLLCDVLVREVSELTGYDRVMAYKFHEDE--HGEVIAECRRSD- |
| zmphyc1 | KAISRLQS--LPSGNLSLLCDVLVREVSELTGYDRVMAYKFYEDE--HGEVISECRRSD- |
| zmphyc2 | KAISRLQS--LPSGNLSLLCDVLVREVSELTGYDRVMAYKFHEDE--HGEVISECRRSD- |
| lephye | RSISRLQS--LPGGDIGVLCDTAVEDVQKLTGYDRVMVYKFHDDN--HGEIVSEIRRSD- |
| atphye | RAISRLQS--LPGGDIGALCDTVVEDVQRLTGYDRVMVYQFHEDD--HGEVVSEIRRSD- |
| inphye | RAISRLQS--LPGGDIGTLCDTVVEDVQKLTGYDRVMVYKFHDDS--HGEVVSEIRRSD- |
| lephyf | KAIRKLQS--LPSGDISLLCDVLVREVSHLTGYDRVMVYKFHEDE--HGEVVAECRTPE- |
| acvphy1 | KAIARLQS--LPGGDIGLLCDSVVEEVHELTGFDRVMAYKFHEDE--HGEVVAEIRRTD- |
| acvphy2 | KAISRLQA--LPVGDIDLLCDSVVEEVRELTGYDRVMAYKFHEDE--HGEVLAEIRRSD- |
| acvphy3 | KPIARVQS--LPGGEIGRLCQVVVEEVQEMTGYDRVMAYKFHEDG--HGEVVAEVRRPD- |
| apphy1 | KAISRLQA--LPVGDIGLLCDSVVEEVRELTGYDRVMAYKFHEDE--HGEVVAEIRRSD- |
| cpphy2 | KAITRLQA--LPGGDIGLLCDTVVEEVRELTGYDRVMAYKFHEDE--HGEVVAEIRRMD- |
| mcphy1 | KAISRLQS--LPGGDIGLLCDAVVEEVRELTGYDRVMAYKFHEDE--HGEVIAEIRRSD- |
| mpphy1 | KAISRLQS--LPGGDIGLLCDTVVEEVRELTGYDRVMAYKFHEDE--HGEVVAEIRRSD- |
| msphy1 | KAISRLQS--LPGGDICGLCDVVVEEVRELTGYDRVMAYKFHDDE--HGEVVAEIRRSD- |
| paphy1 | KAISRLQS--LPGGDIRLLCDTVVQEVRELTGYDRVMAYRFHEDE--HGEVVAEMRRPD- |

-continued

| Name/ SEQ ID No | Sequence |
|---|---|
| ppphy0 | KAITRLQA--LPGGNIGLLCDTVVEEVRELTGYDRVMAYRFHEDE--HGEVVAEIRRAD- |
| ppphy1 | KAITRLQA--LPGGNIGLLCDTVVEEVRELTGYDRVMAYRFHEDE--HGEVVAEIRRAD- |
| ppphy2 | KAISRLQA--LPGGDIGLLCDIVVQEVRELSGYDRVMAYKFHEDE--HGEVLAEIRRSD- |
| ppphy3 | KAITRLQA--LPGGDIGLLCDTVVEEVRELTGYDRVMAYKFHEDE--HGEVVAEIRRTD- |
| ppphy4 | KAISRLQA--LPGGDIGLLCDTVVEEVRQLSGYDRVMAYKFHEDE--HGEVLAEIRRSD- |
| psphy1 | RAISRLQS--LPCGDVGLLCDTVVENVRELTGYDRVMVYKFHEDE--HGEVVAEIRRSD- |
| smphy1 | KAISRLQS--LPGGDIGLLCDTVVEEVRDVTGYDRVMAYKFHEDE--HGEVVAEIRRSD- |
| aphA | LAKASINQ-LQKTANLRDFCQIIVQEVRKVTDFDRVMLYKFDDDG--HGSVIAEEKLDS- |
| cph1 | MANAALNR-LRQQANLRDFYDVIVEEVRRMTGFDRVMLYRFDENN--HGDVIAEDKRDD- |
| cwCph1 | PSESIYSQ-LQTNANLTEFCQIIVQEVRKMTGFDRVMLYKFDEDD--HGEVIAEDKLAE- |
| npCph1 | LARASINQ-LEKTANLRDFCQVIVQEVRKITEFDRVMLYKFDDDG--HGSVIAEEKLES- |
| cwCph1a | LFQDAIIN-TGKTNDLKKLSAKITEEIRKITKFDRVLIYRFENDD--SGVVIAENKRED- |
| npCph1a | FASEAIAK-MQRTSNLGEFLHLVAQEVQKIISFDRVMVYQFDESE--AGSVVAEVKRED- |
| toCphA | LARASINQ-LEKTTNLRDFCQIIVQEVRKVTGFDRVMLYKFDDDG--HGSVIAEEKLDS- |
| aphB | LVKLAMLK-LQGTATTTEISQILAQEVRKITGFDRVMVYRFDEQW--NGKVIAEVKPEY- |
| atBphP1 | ELTSLAKY-LNSAPSLEDALFRTAQLVSSISGHDRTLIYDFGLDW--SGHVVAEAGSGA- |
| atBphP3 | ELTSLAKY-LNSAPSLEDALFRTAQLVSSISGHDRTLIYDFGLDW--SGHVVAEAGSGA- |
| avAphB | LVKLAMLK-LQGAATTTEISQILAQEVRKITGFDRVMVYRFDEQW--NGKVIAEVRPEY- |
| chBphP1 | MSKQFMDY-MEDSHTLIRLCELVASGIKKVTDYDRVMIYRFDKDY--NGEVIAETKQDK- |
| chBphP2 | QIHEASAA-IQQSQELGESLSIAVKELKTFSGFDKVMIYKFDEDW--NGHVLAEAMEPG- |
| drbphp | ALRNAMFA-LESAPNLRALAEVATQTVRELTGFDRVMLYKFAPDA--TGEVIAEARREG- |
| goBphP | EIDSTADR-FERCPDTTSVCRQGAAIFRRLTGFDRVLVYRFMEDG--TGRVVGESRNDA- |
| krBphP | ATRGAIAR-LAGTRGIEGLCERLVREVRVLTGFDRVMAYRFDAQW--NGEVIAEDRRED- |
| mmBphP2 | EAIHLLHS-PTVREQPNASFQILTETIADLTGYGRVLIYRFADDW--SGEVVAETLRRP- |
| paBphP | NAQRIIAQ-VQLHNDTASLLSNVTDELRRMTGYDRVMAYRFRHDD--SGEVVAESRRED- |
| pfBphP | HLGRMLAR-LQKAQSLQALYDISVKEIQAMTGYDRVLIYRFEEEG--HGQVIAEASDPS- |
| ppBphP1 | LARTLIAQ-LREIDQTHKLFRDAARFVRAVLGYDRVMIYQLGADG--AGKVVAESKRSD- |
| ppBphP2 | LVRSFVAS-LQVASSIEDLLQQTVLQLKRITGFGRVKAYRFDAEG--NGQVLAEVVDPG- |
| ppkBphP2 | LVRSFVAS-LQVASSIEDLLQQTVLQLKRITGFGRVKAYRFDAEG--NGQVLAEVVDPG- |
| psBphP1 | NMGRMLRQ-LHAAADLQTLYEVSVREIQRMTGYDRVLIYRFEEEG--HGQVIAEASAPA- |
| psBphP2 | IITRVLRN-LQAATTLETLFDIGVHEIQALTGYDRVMIYRFEPEG--HGKVVAQALTGP- |
| pssBphP1 | NMGRMLRQ-LHAASDLQTLYEVSVREIQKMTGYDRVLIYRFEEEG--HGQVIAEASAPS- |
| pssBphP2 | IITRVLRN-LQAATTLETLFDISVHEIQALTGYDRVMIYRFEPEG--HGQVVAQALTGP- |
| pstBphP1 | NMGRMLRQ-LHAAADLQTLYEVSVREIQRMTGYDRVLIYRFEEEG--HGQVIAEASAPA- |
| rcPpr | AVEADVAV-IRQASSLTGLAQACARSVRVLTGFERAIVYRFDADW--HGEVIAEDKVED- |
| rlBphP | SMRSMMSR-LDHTETLEAFFREGARQARALTGFDRVMVYRFDESG--SGEVVAEAARAG- |
| atBphP2 | TARKMVDR-IREADSVESLISRTTRLVKATLGYDRVMIYRFQEDG--AGKVVSEAKQPE- |
| brBphP | ALDGAFHR-ITSSSSLIGLCDETATIFREITGYDRVMVYRFDEEG--HGEVLSERRRPD- |
| rpBphP1N | TLAPALER-IRTAGSLRALCDDTALLFQQCTGYDRVMVYRFDEQG--HGEVFSERHVPG- |

-continued

| Name/ SEQ ID No | Sequence |
|---|---|
| rpBphP2N | RTNSAIRR-LQAAETLESACAAAAQEVREITGFDRVMIYRFASDF--SGEVIAEDRCAE- |
| rpBphP3N | SVRVAIRR-LQTAADLPTACWIAASEVRRITGFDRIKVYQFAADW--SGQVIAEDRDSG- |
| rpBphP4N | LVQSMIRR-ARPAPNLQGFCDAMAAELRSVTGFDRVMVYRFARDG--SADVIAEARGPE- |
| rpBphP5N | EVRADLAA-LQATEGVQAFFDLAVERIRAFTGYDRVMAYRFAEDG--SGQVIAEARRDD- |
| rpBphP6N | LTRQIIAR-TKELKSLEEMAARVPRYLQAMLGYHRVMMYRFADDG--SGKVIGEAKRSD- |
| rrBphP | RLPFAIGH-ASRAASIEDLCGRAAATVADLTGYERVMVYRFAENW--EGEVIAETLNGP- |
| rsBphP1 | ARQSVIET-FSSAMTQVELCELAVHGLQLVLGYDRVMAYRFGADG-HGEVIAERRRQDR- |
| rsBphP1a | ARQSVIET-FSSAMTQVELCELAVHGLQLVLGYDRVMAYRFGADG--HGEVIAERRRQD- |
| toCphB | LVKAALSK-VQNASTLDELCQIIVKHVRQMNGFDRVMIYRFDENW--HGTVIAEDKSAH- |
| xaBphP | EALPLLRS-IERDAGIDEAAVRAAKGLRSMIGFDRVMVYRFDEEW--NGDVIAEARQPE- |
| xcBphP | EAMPLLRS-VERDPGIAEAAVRVAKGLRSLIGFDRVMIYRFDEEW--NGDIIAEARKPE- |
| anFPH1 | SIVSQIQEQLARADNMEALLDTTSGIVKELTGFHRILVYQFDSEF--NGKVVSELVDPTM |
| bfFPH2 | NAMTQAQEQLAACTSVQKLQDVLVGLIFDLTGFHRVMFYRFDSAK--NGCVEAELLNPKA |
| chFPH1 | NIMSQVQEQLAAAPSLERFLKVLVGVVKELTGFHRVMIYQFDQSF--NGRVVTELVDPRA |
| cnFPH1 | AVLGQINDQLVAAPDLDTFLKVAVGLMQDICRFHRVLIYQFDEQM--NGLVVSELVEWGK |
| gmFPH1 | DIMSQVQEQLSSAPNLEAFLKILVGIVKELTGFHRVMIYQFDSSF--NGKVVTELVDTSM |
| gzFPH1 | DIMSQVQEQLSSATNLEAFLKVLVGIVKELTGFHRVMIYQFDSSF--NGKVVTELVDTSM |
| ncFPH1 | DIMSQVQEQLANAPNLEKFLKILVGIVKELTGFHRVMIYQFDSSF--NGKVVTELVDPMQ |
| ncFPH2 | GMATKIQTQFSEAATVPDLLETIVSIVKEVTRFHRVMVYQFDRDY--NGTVVAELMDPKA |
| umFPH1 | GILSQVNDQLAAQADLNEFLKVLVGIIRDITLFSRVMIYQFDEAW--NGQVVCELVDWND |
| aphC | VLRRITAR-IRQSLELEDIITATTAEVRALLGTDRVMIYKFHPDG--SGQVIAESIYEN- |
| cph2 | FLRNVINK-FHRALTLRETLQVIVEEARIFLGVDRVKIYKFASDG--SGEVLAEAVNRA- |
| npCph2a1 | LLRRITNR-IRRSLELEEIITVTTAEVRSLLKTDRVMIYKFHADG--NGQVIAESIYNN- |
| npCph2a2 | LLHRIASR-IRQSLELQEILSATVAEVRSFLGTDRIKIYQFQADG--HGLVIAESIQED- |
| npCph2b | LLHRMIKQ-IRRSLDLQEILTTTVTEVRSFLRADRVKVYRFDTSG--SGEVIAESIHNE- |
| arphyA | -MEPYLGLHYPATDIPQAARFLFMKNKVRMIVDCNAKHARVLQDE-----------KLS |
| asphya3 | -LEPYLGLHYPATDIPQAARLLFMKNKVRMICDCRARSIKVIEAE-----------ALP |
| asphya4 | -LEPYLGLHYPATDIPQAARFLFMKNKVRMICDCRARSIKVIEAE-----------ALP |
| atphya | -LEPYLGLHYPATDIPQAARFLFMKNKVRMIVDCNAKHARVLQDE-----------KLS |
| cpphya | -LQPYLGLHYPATDIPQAARFLFMKNKVRMIVDCRAKHLKVLQDE-----------KLQ |
| cupphya | -LEPYLGLHYPATDIPQAARFLFMKNKVRMICDCQAKHVKVVQDE-----------KLL |
| gmphya | -LEPYLGLHYPATDIPQASRFLFRKNKVRMIVDCHAKHVRVLQDE-----------KLQ |
| lephya | -LEPYLGLHYPATDIPQAARFLFMKNKVRMICDCRAKHVKVVQDE-----------KLP |
| lsphya | -LEPYLGLHYPATDIPQAARFLFMKNKVRMIVDCNAKHVKVLQDE-----------KLP |
| mgphya | -LEPYLGLHYPATDIPQAARFLFMKNKIRMICDCHAKQVKVIQDD-----------KLP |
| ntphya | -LDPYLGLHYPATDIPQAARFLFMKNKVRMICDCRAKHVKVVQDE-----------KLP |
| omphya | -LEPYVGLHYPATDIPQAARFLFMKNKVRMICDCRANHVKVVQDD-----------NLP |
| osphya | -LEPYLGLHYPATDIPQAARFLFMKNKVRMICDCRARSIKIIEDE-----------SLH |

-continued

| Name/ SEQ ID No | Sequence |
|---|---|
| pcphya | -LEPYFGLHYPATDVPQAARFLFLKNKVRMICDCRANSAPVLQDE-----------KLP |
| psphya | -LEPYLGLHYPATDIPQAARFLFMKNKVRMIVDCNAKHVKVLQDE-----------KLP |
| sbphya | -IEPYLGLHYPATDIPQAARFLFMKNKVRMICDCRAKSVKIIEDE-----------ALS |
| slphya1 | -LDSYLGLHYPATDIPQAARFLFMKNKVRLICDCRAKNVRVVQDE-----------KLS |
| slphya3 | -LDSYLGLHYPATDIPQAARFLFMKNKVRLICDCRAKNVRVVQDE-----------KLS |
| slphya4 | -LDSYLGLHYPATDIPQAARFLFMKNKVRLICDCRAKNVRVVQDE-----------KLS |
| stphya | -LEPYLGLHYPATDIPQAARFLFMKNKVRMICDCRAKHVKVVQDE-----------KLP |
| taphya | -LEPYLGLHYPATDIPQAARFLFMKNKVRLICDVRARPIKVIEDE-----------ALP |
| zmphya1 | -IEPYLGLHYPATDIPQAARFLFMKNKVRMICDCRARSVKIIEDE-----------ALS |
| atphyb | -LEPYIGLHYPATDIPQASRFLFKQNRVRMIVDCNATPVLVVQDD-----------RLT |
| atphyd | -LEPYIGLHYPATDIPQASRFLFKQNRVRMIVDCYASPVRVVQDD-----------RLT |
| gmphyb | -LEPYIGLHYPATDIPQASRFLFKQNRVRMIVDCHASAVRVVQDE-----------ALV |
| lephb1 | -LEPYIGLHYPATDIPQASRFLFKQNRVRMIVDCHATPVRVTQDE-----------SLM |
| lephb2 | -LEPYIGLHYPATDIPQASRFLFKQNRVRMIVDCTAIPVRVIQDE-----------SLM |
| npphyB | -LEPYIGLHYPATDIPQASRFLFKQNRVRMIVDCHATPVRVVQDE-----------SLM |
| ntphyb | -LEPYIGLHYPATDIPQASRFLFKQNRVRMIVDCHATPVRVVQDE-----------SLM |
| osphyb | -LEPYIGLHYPATDIPQASRFLFRQNRVRMIADCHAAPVRVIQDP-----------ALT |
| pbphyb1 | -LEPYIGLHYPSTDIPQASRFLFKQNRVRMIVDCHATPVRVIQDE-----------ALM |
| pbphyb2 | -LEPYIGLHYPSTDIPQASRFLFKQNRVRMIVDCHAIPVRVIQDE-----------ALM |
| sbphyB | -LEPYLGLHYPATDIPQASRFLFRQNRVRMIADCHATPVRVIQDP-----------GMS |
| slphyb | -LEPYLGLHYPATDIPQASRFLFKQNRVRMIVDCHADSVSVVQDE-----------RLR |
| stphyb1 | -LEPYIGLHYPATDIPQASRFLFKQNRVRMIVDCHATPVRVTQDE-----------SLM |
| stphyb2 | -LEPYIGLHYPATDIPQASRFLFKQNRVRMIVDCHATPVRVTQDE-----------SLM |
| zmphyb1 | -LEPYLGLHYPATDIPQASRFLFRQNRVRMIADCHATPVRVIQDP-----------GLS |
| zmphyb2 | -LEPYLGLHYPATDIPQASRFLFQQNRVRMIADCHAIPVRVIQDP-----------GLS |
| atphyc | -MEPYLGLHYSATDIPQASRFLFMRNKVRMICDCSAVPVKVVQDK-----------SLS |
| osphyc | -LEPYLGLHYPATDIPQASRFLFMKNKVRMICDCSATPVKIIQDD-----------SLT |
| sbphyc | -LEPYLGLHYPATDIPQASRFLFMKNKVRMICDCSATLVKIIQDD-----------SLA |
| slphyc | -LDSYLGLHYPATDIPQASRFLFLKNKVRMICDCRSPSVKVIQDE-----------ALT |
| taphyc | -LEPYLGLHYPATDIPQASRFLFMKNKVRMICDCAASPVKLIQDD-----------NLS |
| zmphyc1 | -LEPYLGLHYPATDIPQASRFLFMKNKVRMICDCCATPVKVIQDD-----------SLA |
| zmphyc2 | -LEPYLGLHYPATDIPQASRFLFMKNKMRMICDFSATPVLIIQDG-----------SLA |
| lephye | -LEPYLGLHYPATDIPQAARFLFKQNRVRMICDCNAQPVKVVQSE-----------ELK |
| atphye | -LEPYLGLHYPATDIPQAARFLFKQNRVRMICDCNATPVKVVQSE-----------ELK |
| inphye | -LEPYLGLHYPATDIPQAARFLFKQNRVRMICDCNAQPVKVLQCE-----------ELK |
| lephyf | -LEPYLGLHYPATDIPQASRFLFMKNKVRMICDCLAPPIRVIQDP-----------RLA |
| acvphy1 | -LEPYIGLHYPATDIPQAARFLFMKNRYKMICDCRLPPVKLIQDK-----------TLS |
| acvphy2 | -LEPYLGLHYPATDIPQASRFLFMKNRVRMICDCRALPVRVIQDK-----------ELR |
| acvphy3 | -LEPYLGLHYPSTDVPQASRMMFMKNGVRMIGDCTLPPVRVVQAK-----------ELA |

-continued

| Name/SEQ ID No | Sequence |
|---|---|
| apphy1 | -LAPYLGLHYPATDIPQASRFLFMKNRVRMICNCAATPVRVIQDK------------GLR |
| cpphy2 | -LEPYLGLHYPATDIPQASRFLFMKNRVRVIADCCASPVKLIQDP------------DIK |
| mcphy1 | -LEPYLGLHYPATDIPQAARFLFMKNRVRIICDCSAPPVKVIQDP------------TMK |
| mpphy1 | -LEPYLGLHYPATDIPQASRFLFMKNRVRMICDCCAQPVQVIQDK------------ELR |
| msphy1 | -LEPYLGLHYPATDIPQASRFLFIKNRIRMICDCTSPQVKVVQDS------------RIP |
| paphy1 | -LEPYLGLHYPATDIPQASRFLFMKNRVRMICDCCAPPVNVIQDK------------RLR |
| ppphy0 | -LEPYLGLHYPGTDIPQASRFLFMKNKVRIIADCSAPPVKVIQDP------------TLR |
| ppphy1 | -LEPYLGLHYPGTDIPQASRFLFMKNKVRIIADCSAPPVKVIQDP------------TLR |
| ppphy2 | -LEPYLGLHYPATDIPQASRFLFMKNKVRMIGDCFASPVKVIQDK------------DLR |
| ppphy3 | -LEPYLGLHYPATDIPQASRFLFMKNRVRMIGDCSAPPEKIVQDP------------NLR |
| ppphy4 | -LEPYLGLHYPATDIPQASRFLFMKNRVRMIGDCYAPPVKVVQDK------------DLR |
| psphy1 | -LEPYLGLHYPATDIPQASRFLFMQNRVRMICDCMATPVKVIQSE------------ELM |
| smphy1 | -LEPYLGLHYPATDIPQASRFLFMKNRVRMICDCSAPPVKITQDK------------ELR |
| aphA | -LEPYLGLHYPESDIPKPARKLFISNSIRVIPNAQAQAIQMIPALN----------PVSD |
| cph1 | -MEPYLGLHYPESDIPQPARRLFIHNPIRVIPDVYGVAVPLTPAVN----------PSTN |
| cwCph1 | -LEPYLGLHYPASDIPLPARRLFSSNYIRLIPDAKATGIDLFSKLH----------PLND |
| npCph1 | -LEPYLGLHYPESDIPKPARKLFAANSIRIIPDAYSQPVKLFPVNN----------PISD |
| cwCph1a | -IESYLGLHYPYYDIPNPARQFFSKKLLRMIPNIHDEPIPILPRKH----------PLKK |
| npCph1a | -LSPYLGLHYPATDIPAQARELYTRCFLRFLPDLTAEPVKLVPTEN----------PTTH |
| toCphA | -MEPYLGLHYPESDIPKPARKLFASNFIRLIPDAHAEPVQILPINH----------PQSQ |
| aphB | -LTSYLGLNYPASDIPQQARKLYSQNWLRLIPDAKYQPVPIVPINN----------PLND |
| atBphP1 | -LPSYLGLRFPAGDIPPQARQLYTINRLRMIPDVDYKPVPIRPEVN----------AETG |
| atBphP3 | -LPSYLGLRFPAGDIPPQARQLYTINRLRMIPDVDYKPVPIRPEVN----------AETG |
| avAphB | -LTSYLGLHYPASDIPQQARKLYSQNWLRLIPDAKYQPVPIVPTNH----------PLNN |
| chBphP1 | -LESFLGLHYPHTDIPVQARELYIKNLLRVIGDVNYKPVPIYTIDD-----------SEN |
| chBphP2 | -MESYLGITFPASDIPKQARELYLKNPYRLIPDREYKPSKLYPVIN----------PASS |
| drbphp | -LHAFLGHRFPASDIPAQARALYTRHLLRLTADTRAAAVPLDPVLN----------PQTN |
| goBphP | -FPSLMNHHFPASDIPTQARALYLRNRIRVIPDITYEAAPIRPPE------------AGL |
| krBphP | -LDTFLGLHYPASDIPAQARRLYTLNWMRLIADVDYVPSPLHPLLD----------PGTG |
| mmBphP2 | -MQSYQGLHFPAADIPVIARDLYTLNRQRYIRDALAGSVPILGCD------------PAD |
| paBphP | -LESYLGQRYPASDIPAQARRLYIQNPIRLIADVAYTPMRVFPALN----------PETN |
| pfBphP | -MEVFNGLFFPASDIPEQARELYRTNWLRIIPNADYQPVPLVPKLR----------PDTQ |
| ppBphP1 | -LESFMGQYFPASDIPQQARALYLRNPIRVISDAQFNTVAINPVLD-----------PSG |
| ppBphP2 | -YPSYAGLCFPAADIPRQARELYRVNRIRVIEDANYQPSPLLPATN----------PRTG |
| ppkBphP2 | -YPSYAGLCFPAADIPRQARELYRVNRIRVIEDANYQPSPLLPATN----------PRTG |
| psBphP1 | -MELFNGLFFPASDIPEQARELYRRNWLRIIPDANYTPVPLVPQLR----------PDTQ |
| psBphP2 | -LPSYSGLNFPGSDIPAQARELYRLNWIRLIPDATYVPVALIPTLR----------PATG |
| pssBphP1 | -MELFNGLFFPASDIPEQARELYRRNWLRIIPDADYIPVPLVPQLR----------PDTQ |

-continued

| Name/ SEQ ID No | Sequence |
|---|---|
| pssBphP2 | -LPSYSGLNFPGSDIPAQARELYRLNWIRVIPDATYVPVPLIPTLR----------PATG |
| pstBphP1 | -MELFNGLFFPASDIPEQARELYRRNWLRIIPDANYTPVPLVPQLR----------PDTQ |
| rcPpr | WPQSFAGLHFPASDIPRQARELYSQSLSRHVPDRDYVPVPVHRI------------EGT |
| rlBphP | -IGSFLGLHYPASDIPVQARALYLRNLFRIIADVDAVPVPILPPLD-----------EHG |
| atBphP2 | -LESFLGQYFPASDIPQQARALYLKNTLRIISDASGTRIPVLPAVD-----------VSG |
| brBphP | -LEAFLGNRYPASDIPQIARRLYERNRVRLLVDVNYTPVPLQPRIS----------PLNG |
| rpBphP1N | -LESYFGNRYPSSDIPQMARRLYERQRVRVLVDVSYQPVPLEPRLS----------PLTG |
| rpBphP2N | -VESYLGLHFPASDIPAQARRLYTINPVRIIPDINYRPVPVTPDLN----------PVTG |
| rpBphP3N | -IPSLLDFHFPSSDIPAQSRALYTINPVRIIPDIGYRPSPLVPDIN----------PRLG |
| rpBphP4N | -TSPFLGLRDPQPDISNQPGSIS---RIRVQPDVHAPAAPLWPAHS----------PRNG |
| rpBphP5N | -LEPYLGLHYPATDIPAPARRLFALSWVRHLPDVGYTPVPLLAAKS----------PLVT |
| rpBphP6N | -LESFLGQHFPASDIPQQARLLYLKNAIRVISDSRGISSRIVPERD-----------ASG |
| rrBphP | -VESYKGQRFPASDIPAQARALYSRNLLRSIPDVHYRPLPLVGRS-----------PDG |
| rsBphP1 | -LEPYLGLHYPASDIPQIARALYLRQRVGAIADACYRPVPLLGHPE----------LDDG |
| rsBphP1a | -LEPYLGLHYPASDIPQIARALYLRQRVGAIADACYRPVPLLGHPE----------LDDG |
| toCphB | -LSPYLSLRYPASDIPKQARQLYRDNWLRLIPDVDYQPVALLPHHN----------PVTN |
| xaBphP | -LEAYLGLHYPASDIPAQARALYLRNRVRQIADVRYQPSPIQPTLH----------PRLG |
| xcBphP | -LEAYLGLHYPASDIPAQARALYLRNRVRQIADVGYQPSPIQPTVH----------PQLG |
| anFPH1 | SIDLFKGLHFPAADIPKQARDLYRINKVRLLYDRDHVTARLVCRAL----------EDLE |
| bfFPH2 | SDDIFRGLHFPASDIPKQALDLYKINRIRMLHDRDEKTARLVCRHQ----------SDFE |
| chFPH1 | TKDLYKGLNFPASDIPKQARELYKINKVRMLYDRDLQTARLVCRTA----------EDLE |
| cnFPH1 | TTDLYMGLRFPATDIPPQARELYKINKVRMLYDRSQTTARMVLRNK----------EDLD |
| gmFPH1 | TRDLYKGLHFPASDIPRQARDLYKLNKVRLLYDRDQDTSRIVCRTK----------EDLD |
| gzFPH1 | TRDLYKGLHFPASDIPRQARDLYKLNKNCLPNKRRPRHSARHEPLL-------------- |
| ncFPH1 | TRDLYKGLHFPATDIPSQARELYKLNKVRLLYDRDVESARIVCRTP----------EDLE |
| ncFPH2 | SNDVYRGLHFPASDIPPQARKLYMINKVRVLFDRSQRTSRLIGRDV----------SDMD |
| umFPH1 | SHDLYRGLHFPATDIPAQARALYKINKVRLLYDRDQPTARMICRDQ----------ADLD |
| aphC | RLPSLLGLNFPADDIPPQARELLVKSKVRSIVDVATGMIGQSPVHD----------LETG |
| cph2 | ALPSLLGLHFPVEDIPPQAREELGNQRKMIAVDVAHRRKKSHELSG-----------RIS |
| npCph2a1 | RLPSLLGLNFPADDIPLSARELFLKLRVRSVVNVDTQEIGQIHLRD----------LDNG |
| npCph2a2 | RLPPLLGLNFPADDIPPYARELFVRARQRCIVDLTTQEIGISPLDC----------PETG |
| npCph2b | RLPSLLGLRFPVHDIPEAAREMFLLAGQRSIVDVANHKIGLSPLQS----------TETG |
| arphyA | FDLTLCGSTLRAPHSCHLQYMANMDSIASLVMAVVVNEEDGEGDAPDS---TTQPQKRKR |
| asphya3 | FDISLCGSALRAPHSCHLQYMENMNSIASLVMAVVVNENEEDDEAESEQ--PAQQQKKKK |
| asphya4 | FDISLCGSALRAPHSCHLQYMENMNSIASLVMAVVVNENEEDDEAESEQ--PAQQQQKKK |
| atphya | FDLTLCGSTLRAPHSCHLQYMANMDSIASLVMAVVVNEEDGEGDAPDA---TTQPQKRKR |
| cpphya | FDLTLCGSTLRAPHSCHLQYMENMNSIASLVMAVVVNEGDEENEGP-----ALQQQKRKR |
| cupphya | FDLTLCGSTLRAPHTCHLQYMENMNSIASLVMAIVVNDGDDE-EEEE----RSGSGKRKR |
| gmphya | FDLILCGSTLRAPHSCHAQYMANMDSIASLVLAVVVNDNEEDGDTD-----AVQPQKTER |

-continued

| Name/ SEQ ID No | Sequence |
|---|---|
| lephya | FDLTLCGSTLRAPHYCHLQYMENMNSIASLVMAVVVNDGDEEGESSD----SSQSQKRKR |
| lsphya | FDLTLCGSTLRAPHSCHLQYMANMDSIASLVMAVVVNDSDEDGDSAD----AVLPQKKKR |
| mgphya | IDLTLCGSTLRAPHSCHLQYMENMNSIASLVMSVVVNEGDEEGDGGGSSVSSNQQQKIKR |
| ntphya | FDLTLCGSTLRAPHYCHLQYMENMSSIASLVMAVVVNDGDEEGESSD----STQSQKRKR |
| omphya | FDLTLCGSTLRAPHGCHSQYMENMNSIASLVMSVVVNEGDEDGPDSS-----SGPYKRKR |
| osphya | LDISLCGSTLRAPHSCHLQYMENMNSIASLVMAVVVNENEDDDEVGADQP--AQQQKRKK |
| pcphya | FELTLCGSTLRAPHSCHLQYMENMNSIASLVMAVVINDSDEVVESSD-----RNSVKSKK |
| psphya | FDLTLCGSTLRAPHSCHLQYMANMDSIASLVMAVVVNDSDEDGDSAD----AVLPQKKKR |
| sbphya | IDISLCGSTLRAPHSCHLQYMENMNSIASLVMAVVVNENEEDDEPGPEQP--PQQQKKKR |
| slphya1 | VDLTLCGSTLRAPHGCHAQYMENMNSIGSLVMAVVVNDEDDEDGGSAP----AQPHKRKR |
| slphya3 | VDLTLCGSTLRAPHGCHAQYMENMNSIGSLVMAVVVNDEDDEDGGSAP----AQPHKRKR |
| slphya4 | VDLTLCGSTLRAPHGCHAQYMENMNSIGSLVMAVVVNDEDDEDGGSAP----AQPHKRKR |
| stphya | FDLTLCGSTLRAPHYCHLQYMENMNSIASLVMAVVVNDGDEEGESSD----SSQSQKRKR |
| taphya | FDISLCGSALRAAHSCHLQYMENMNSIASLVMAVVVNENEEDDEVGSEQP--AQQQKKKI |
| zmphya1 | IDISLCGSTLRAPHSCHLQYMENMNSIASLVMAVVVNENEDDDEPESEQP--PQQQKRKK |
| atphyb | QSMCLVGSTLRAPHGCHSQYMANMGSIASLAMAVIINGNEDDGSN------VASGRSSMR |
| atphyd | QFICLVGSTLRAPHGCHAQYMTNMGSIASLAMAVIINGNEEDGNGV-----NTGGRNSMR |
| gmphyb | QPLCLVGSTLGAPHGCHAQYMANMGSIASLVMAVIINGNDEEG---------VGGRSSMR |
| lephb1 | QPLCLVGSTLRAPHGCHAQYMANMGSIASLTLAVIINGNDEEAV--------GGGRNSMR |
| lephb2 | QPLCLVGSTLRAPHGCHPQYMVNMGNVASLTLAVVINGNDDEVV---------GGRNAMR |
| npphyB | QPLCLVGSTLRAPHGCHAQYMANMGSIASLTLAVIINGNDEEAV---------GGRSSMR |
| ntphyb | QPLCLVGSTLRAPHGCHAQYMANMGSIASLTLAVIINGNDEEAV---------GGRSSMR |
| osphyb | QPLCLVGSTLRSPHGCHGQYMANMGSIASLVMAVIISSGGDDDHN-IA---RGSIPSAMK |
| pbphyb1 | QPLCLVGSTLRAPHGCHAQYMANMGSIASLAMAVIINGNEEEAI---------GGRNSTR |
| pbphyb2 | QPLCLVGSTLRAPHGCHAQYMENMGSIASLAMAVIIYGNDEEAI---------GGRNSMR |
| sbphyB | QPLCLVGSTLRAPHGCHAQYMANMGSIASLVMAVIISSGGDDEQTG-----RGGISSAMK |
| slphyb | QPLCLVGSTLRAPHGCHSQYMANMGSIASLVMAVIINGNDDEG----------STRNAMR |
| stphyb1 | QPLCLVGSTLRAPHGCHAQYMANMGSIASLTLAVIINGNDEEAV--------GGGRNSMR |
| stphyb2 | QPLCLVGSTLRAPHGCHAQYMANMGSIASLTLAVIINGNDEEAV--------GGGRNSMR |
| zmphyb1 | QPLCLVGSTLRAPHGCHAQYMANMGSIASLVMAVIISSGGDDEQTG-----RGGISSAMK |
| zmphyb2 | QQLCLVGSTLRAPHGCHAQYMANMGSIASLVMAVIISSGGDDERTG-----RGAISSSMK |
| atphyc | QPISLSGSTLRAPHGCHAQYMSNMGSVASLVMSVTINGSDSDEMN-------RDLQTGRH |
| osphyc | QPISICGSTLRAPHGCHAQYMASMGSVASLVMSVTINEDEDDDGDTGSD----QQPKGRK |
| sbphyc | QPLSLCGSTLRASHGCHAQYMANMGSVASLVMSVTISNDEEEDVDTGSD----QQPKGRK |
| slphyc | QPLSLGGSTLRAPHGCHAQYMANMGSIASLVMAVTINNEEDEVSD---------RHRTRK |
| taphyc | QPISLCGSTMRAPHGCHAQYMANMGSIASLVMSITINEDDDEDGDTGSD----QQPKGRK |
| zmphyc1 | QPLSLCGSTLRASHGCHAQYMANMGSVASLAMSVTINEDEEEDGDTGSD----QQPKGRK |
| zmphyc2 | QPVSLCGSTLRASHGCHAQYMANMGSVASLVMSVTINDDEEEDGDTDSD----QQPKGRK |

-continued

| Name/ SEQ ID No | Sequence |
|---|---|
| lephye | QPICLVNSTLRSPHECHSKYMANMGSISSLVMAILINSGD-----------------SMK |
| atphye | RPLCLVNSTLRAPHGCHTQYMANMGSVASLALAIVVKGKD-----------------SSK |
| inphye | QPLCLVNSTLRSPHGCHTKYMANMGSIASLVMAVVINSSE-----------------SMK |
| lephyf | QSLSLGGSTLRAPHGCHAQYMTNMGTVASMAMSVMINEQDDELDSD--------QQVGRK |
| acvphy1 | QPMSLTGSTLRAPHGCHTQYMANMNSISSLVKAVIVNDSDDDSA--------GHSSQGIK |
| acvphy2 | QPLSLAGSTLRAPHGCHSQYMANMGSIASLVMAVVVNDNDEDVSN------RSQQPKMRR |
| acvphy3 | QPISLAGSTLRAPHGCHAQYMSNMGSAASLTMAVAIDDYDDDSS---------LSCGSRK |
| apphy1 | QPLSLAGSTLRAPHDCHSQYMANMGTIASLVMAVIVNDNDEEVSN------RTHQPKQRK |
| cpphy2 | QPVSLAGSTLRAPHGCHAQYMGNMGSIASLVMAVIINDNEEDS--------RGAIQRGRK |
| mcphy1 | HPISLAGSTLRGVHGCHAQYMANMGSVASLVMAVIINDNSSEEGATAAG---GILHKGRK |
| mpphy1 | QPLSLAGSTLRAPHGCHAQYMGNMGSIASLVMAVIINVNDEEYSS------RGYHHKGRK |
| msphy1 | QEMSLAGSTMRGVHGCHTQYMMNMGSTASLVMSVTINDTNEIAG--------GPGMKGRK |
| paphy1 | QPLSLCGSTLRAPHGCHAQYMANMGSIASLVMSVTTNENGDDSEGGGQ----QQPQNRRK |
| ppphy0 | QPVSLAGSTLRSPHGCHAQYMGNMGSIASLVMAVIINDNEEDS--------HGSVQRGRK |
| ppphy1 | QPVSLAGSTLRSPHGCHAQYMGNMGSIASLVMAVIINDNEEDS--------HGSVQRGRK |
| ppphy2 | QPISLAGSTLRAPHGCHAQYMGNMNSIASLVMAVIVNDPDEDPN------ARGGQQRGRK |
| ppphy3 | QPVSLAGSTLRSPHGCHAQYMGNMGSISSIVMAVIINDNEDDS--------RGSVQRGRK |
| ppphy4 | QPISLAGSTLRAPHGCHAQYMGNMNSIASLVMAVIVNDPDEDPNS------RGGQQRGRK |
| psphy1 | QPLCLVGSTPSAPHGCHAQYMANMGSIRSLLMAVIINGNDDEGG--------GSGRNSMK |
| smphy1 | QPISLAGSTLRAPHGCHAQYMGNMGSVASLVMAMIINDNDEPSGGGGG----GGQHKGRR |
| aphA | RPVDLTNSILRSAANCHLEYLHNMGVGASLTISLIKD---------------------NK |
| cph1 | RAVDLTESILRSAYHCHLTYLKNMGVGASLTISLIKD---------------------GH |
| cwCph1 | TALDLTHSILRSASPCHLEYLHNMGVGASLTISLIDD---------------------RK |
| npCph1 | RPINLTNSILRSAASCHTEYLHNMGVGASLTISLIKD---------------------QK |
| cwCph1a | KKLDLQNAFLRSIAPCHIEYLKNMGVTASFNISLLKE---------------------NK |
| npCph1a | QHLDLSYCLLRSFDWCCAEYHQNMGVKALLVISLIQE---------------------QK |
| toCphA | QPIDLTNSILRTAANCHLEYLHNMGVGASLTISLIKD---------------------GK |
| aphB | QPLDLSRSVLRSVSPLHIEYMQNMGVTASMSISIMKN---------------------QK |
| atBphP1 | AVLDMSFSQLRSVSPVHLEYMRNMGTAASMSVSIVVN---------------------GA |
| atBphP3 | AVLDMSFSQLRSVSPVHLEYMRNMGTAASMSVSIVVN---------------------GA |
| avAphB | QPLDLSRSVLRSVSPLHIEYMQNMGVTASMSISIMKN---------------------QK |
| chBphP1 | QNLDLSCSVLRSVSPIHVQYLHNIGVGATLTISLIHK---------------------KK |
| chBphP2 | GFVDLGVCNLRGVIKVHLEYLTNMNVKSSMSTRILKD---------------------NT |
| drbphp | APTPLGGAVLRATSPMHMQYLRNMGVGSSLSVSVVVG---------------------GQ |
| goBphP | AGLDLSDVQLRSVSPIHLQYMANMGTRASASVSLVVD---------------------GV |
| krBphP | APLDLSHSVLRSVSPIHVEYLKNMGVGASMSISLIVE---------------------GR |
| mmBphP2 | GAPDQTFGDLRSVSPMHLTYLGNMGVRASFSASILMR---------------------GK |
| paBphP | ESFDLSYSVLRSVSPIHCEYLTNMGVRASMSISIVVG---------------------GK |
| pfBphP | TPLDLSFATLRSVSPIHCQYMKNMGVLSSMSISLLKG---------------------DK |

-continued

| Name/ SEQ ID No | Sequence |
|---|---|
| ppBphP1 | EPLDLSYAHLRSVSPIHCEYLCNMGVGASMSISVIVN---------------------GE |
| ppBphP2 | KPLDMSFAALRSVSPVHLQYMRNMGTLASMSLSIVVD---------------------GQ |
| ppkBphP2 | KPLDMSFAALRSVSPVHLQYMRNMGTLASMSLSIVVD---------------------GQ |
| psBphP1 | QQLDLSFSTLRSVSPIHCQYMKNMGVLSSMSVSLIQG---------------------GK |
| psBphP2 | QPLDLSLSTLRSVSPVHCEYLKNMGVRSSMSISLLDG---------------------GE |
| pssBphP1 | QQLDLSFSTLRSVSPIHCQYMKNMGVLSSMSVSLIQS---------------------GK |
| pssBphP2 | QPLDLGFSTLRSVSPVHCEYLKNMGVRSSMSISLLDG---------------------GE |
| pstBphP1 | QQLDLSFSTLRSVSPIHCQYMKNMGVLSSMSVSLIQG---------------------GK |
| rcPpr | EPLDLSFSRHRSLSPVHLQYLRNMGVTASMSFSILVE---------------------GR |
| rlBphP | QPLDLSMSVLRSVSPIHIEYLKNMGVGASLSISIVVD---------------------GK |
| atBphP2 | EPLDLSYAHLRSVSPIHCEYLRNMGVAASMSISVIVD---------------------GA |
| brBphP | RDLDMSLSCLRSMSPIHQKYLQNMGVGATLVCSLMVS---------------------GR |
| rpBphP1N | RDLDMSGCFLRSMSPIHLQYLKNMGVRATLVVSLVVG---------------------GK |
| rpBphP2N | RPIDLSFAILRSVSPVHLEYMRNIGMHGTMSISILRG---------------------ER |
| rpBphP3N | GPIDLSFSVLRSVSPTHLEYMVNMGMHAAMSISIVRD---------------------NR |
| rpBphP4N | LALDLSFSATRSASPEHRLYLAQLGVAASLSLSLVVE---------------------GE |
| rpBphP5N | GPVDMSFASLRSVSVMYTGYLKNMGVQSTLVMPLVKE---------------------GR |
| rpBphP6N | AALDLSFAHLRSVSPIHLEYLRNMGVSASMSLSIIID---------------------GT |
| rrBphP | RELDMTFCNLRSVSPVHLEYLRNMGVAASFSVSLVVD---------------------GR |
| rsBphP1 | KPLDLTHSSLRSVSPVHLDYMQNMNTAASLTIGLADG---------------------DR |
| rsBphP1a | KPLDLTHSSLRSVSPVHLDYMQNMNTAASLTIGLADG---------------------DR |
| toCphB | QPTDLSHSVLRSVSPLHIEYLHNMGVKASMSISLLKN---------------------QK |
| xaBphP | TPVDLSDVSLRSVSPVHLEYLANMGVSATLVSSIVVN---------------------DA |
| xcBphP | TPVDLSDVSLRSVSPVHLEYLANMGVTATLVASIVVN---------------------DA |
| anFPH1 | TPLDMTHAYLRAMSPIHIKYLANMQIRSSMSISINSM---------------------ND |
| bfFPH2 | KPLDLTHAYLRAMSPLHLKYLSNMGVRSTMSVSIVIN---------------------GD |
| chFPH1 | VPLDLTHSYLRAMSPIHLKYLANMAVRSSMSISINAF---------------------GE |
| cnFPH1 | QPLDMTHCYLRAMSPIHLKYLGNMSVRSSMSISIMAF---------------------GQ |
| gmFPH1 | VPLDMSHSYLRAMSPIHIKYLKNMAVRSSMSISINAF---------------------NE |
| gzFPH1 | ---------SASHVAYSYHYLKNMAVRSSMSISINAF---------------------NE |
| ncFPH1 | TPLDMTHSYLRAMSPIHLKYLANMAVRSSMSISINAF---------------------GD |
| ncFPH2 | VPLDLTHAYLRAMSPVHLKYLSNMGVRSSMSMSLESD---------------------GK |
| umFPH1 | FPVDMTHAFIRAMSPIHIKYLTNMGVRSSMSVSITAF---------------------GE |
| aphC | ELIS-EDICYRPVDSCHVEYLTAMGVKSSVVAPIFCQ---------------------DE |
| cph2 | PTEH-SNGHYTTVDSCHIQYLLAMGVLSSLTVPVMQD---------------------QQ |
| npCph2a1 | ETIS-EEIRYRSVDSCHIEYLTAMGVKSSVVAPILYQ---------------------DQ |
| npCph2a2 | KPLEQQDIRYRPVDPCHLEYLTAMGVKSSVVVPIVLKNQETGKDSSPNVM------ESSQ |
| npCph2b | KHLQ-TNIYYRKVDPCHIQYLKAMGVQSSLVVPILDSDPQQS--------------AKPK |

-continued

| Name/ SEQ ID No | Sequence |
|---|---|
| arphyA | LWGLV-VCHNTTPR--FVPFPLRYACEFLAQVFAIHVNKEVELENQIVEKNILRTQ-TLL |
| asphya3 | LWGLL-VCHHESPR--YVPFPLRYACEFLAQVFAVHVNREFELEKQLREKNILKMQ-TML |
| asphya4 | LWGLL-VCHHESPR--YVPFPLRYACEFLAQVFAVHVNREFELEKQLREKSILKMQ-TML |
| atphya | LWGLV-VCHNTTPR--FVPFPLRYACEFLAQVFAIHVNKEVELDNQMVEKNILRTQ-TLL |
| cpphya | LWGLV-VCHNSSPR--FVPFPLRYACEFLAQVFAIHVNKELELENQIIEKNILRTQ-TLL |
| cupphya | LWGLV-VCHNTTPR--FVPFPLRYACEFLAQVFAIHVNKELELENQIVEKNILRTQ-TLL |
| gmphya | LWGLV-VCHNTTPR--FVPFPLRYAREFLPQVFADHVHKEIELEYQIIEKNILHHP-GHL |
| lephya | LWGLV-VCHNTTPR--FVPFPLRYACEFLAQVFAIHVNKELELENQFLEKNILRTQ-TLL |
| lsphya | LWGLV-VCHNTTPR--FVPFPLRYACEFLAQVFAIHVNKEIELEYQILEKNILRTQ-TLL |
| mgphya | LWGLL-VCHNTTPR--FVPFPLRYACEFLAQVFTIHVNKELELENQIHEKNILRTQ-TLL |
| ntphya | LWGLV-VCHNTTPR--FVPFPLRYACEFLAQVFAIHVNKELELESQILEKNILRTQ-TLL |
| omphya | LWGLV-VCHNTCPR--FIPFPLRYACEFLVQVFSIHVNKELELENQMLEKNILRTQ-TLL |
| osphya | LWGLL-VCHHESPR--YVPFPLRYACEFLAQVFAVHVNKEFELERQVREKSILRMQ-TML |
| pcphya | LWGLV-VCHNTSPR--FVPFPLRYACEFLAQVFAIHVSKELELENQIVEKNILRTQ-TLL |
| psphya | LWGLV-VCHNTTPR--FVPFPLRYACEFLAQVFAIHVNKEIELEYQILEKNILRTQ-TLL |
| sbphya | LWGLI-VCHHESPR--YVPFPLRYACEFLAQVFAVHVNKEFELEKQIREKSILRMQ-TML |
| slphya1 | LWGLV-VCHHTSPR--FVPFPLRYACEFLAQVFAIHVNKELELENQFLEKKILRTQ-TLL |
| slphya3 | LWGLV-VCHHTSPR--FVPFPLRYACEFLAQVFAIHVNKELELESQFLEKKILRTQ-TLL |
| slphya4 | LWGLV-VCHHTSPR--FVPFPLRYACEFLAQVFAIHVNKELELENQFLEKKILRTQ-TLL |
| stphya | LWGLV-VSHNTTPR--FAPFPLRYACEFLAQVFAILVNKELELENQFLEKNILRTQ-TLL |
| taphya | LWGLI-VCHHESPR--YVPFPLRYACEFLAQVFAVHVNKEFEVQKQLREKSILRMQ-TIL |
| zmphya1 | LWGLI-VCHHESPR--YVPFPLRYACEFLAQVFAVHVNKEFELEKQIREKSILRMQ-TML |
| atphyb | LWGLV-VCHHTSSR--CIPFPLRYACEFLMQAFGLQLNMELQLALQMSEKRVLRTQ-TLL |
| atphyd | LWGLV-VCHHTSAR--CIPFPLRYACEFFMQAFGLQLNMELQLALQVSEKRVLRMQ-TLL |
| gmphyb | LWGLV-VCHHTSAR--CIPFPLRYACEFLMQAFGLQLNMELQLAAQSLEKRVLRTQ-TLL |
| lephb1 | LWGLV-VGHHTSVR--SIPFPLRYACEFLMQAFGLQLNMELQLASQLSEKHVLRTQ-TLL |
| lephb2 | LWGLV-VGHHSSAR--FIPFPLRYACEFLMQAFGLQLNMELQLASQLAEKRVLRTQ-TVL |
| npphyB | LWGLV-VGHHTSAR--CIPFPLRYACEFLMQAFGLQLNMELQLASQLSEKHVLRTQ-TLL |
| ntphyb | LWGLV-VGHHTSAR--CIPFPLRYACEFLMQAFGLQLNMELQLASQLSEKHVLRTQ-TLL |
| osphyb | LWGLV-VCHHTSPR--CIPFPLRYACEFLMQAFGLQLNMELQLAHQLSEKHILRTG-TLL |
| pbphyb1 | LWGLV-VCHHTSAR--CIPFPLRYACEFLMQAFGLQLNMELQLASQLSEKHVLRTQ-TLL |
| pbphyb2 | LWGLV-VCHHTSAR--CIPFPLRYACEFLMQAFGLQLNMELQLASQLLEKHVLRTQ-TLL |
| sbphyB | LWGLV-VCHHTSPR--CIPFPLRYACEFLMQAFGLQLNMELQLAHQLSEKHILRTQ-TLL |
| slphyb | LWGLV-VCHHTSPR--SIPFPLRYACEFLMQAFGLQLNMELQLSAQVLEKRVLRTQ-TLL |
| stphyb1 | LWGLV-VGHHTSVR--SIPFPLRYACEFLMQAFGLQLNMELQLASQLSEKHVLRTQ-TLL |
| stphyb2 | LWGLV-VGHHTSVR--SIPFPLRYACEFLMQAFGLQLNMELQLASQLSEKHVLRTQ-TLL |
| zmphyb1 | LWGLV-VCHHTSPR--CIPFPLRYACEFLMQAFGLQLNMELQLAHQLSEKHILRTQ-TLL |
| zmphyb2 | LWGLV-VCHHTSPR--CIPFPLRYACEFLMQAFGLQLNMELQLAHQLSEKHILRTQ-TLL |
| atphyc | LWGLV-VCHHASPR--FVPFPLRYACEFLTQVFGVQINKEAESAVLLKEKRILQTQ-SVL |

-continued

| Name/ SEQ ID No | Sequence |
|---|---|
| osphyc | LWGLM-VCHHTSPR--FVPFPLRYACEFLLQVFGIQINKEVELAAQAKERHILRTQ-TLL |
| sbphyc | LWGLV-VCHHTSPR--FVPFPLRYACEFLLQVFGIQLNKEVELAAQAKERHILRTQ-TLL |
| slphyc | LWGLV-VCHHTSSR--FVPYPLRYACEFLVQVFGIHINKEVELAAQVREKHILKIQ-SML |
| taphyc | LWGLV-VCHHTSPR--FVPFPLRYACEFLLQVFGIQLNKEVELASQAKERHILRTQ-TLL |
| zmphyc1 | LWGLV-VCHHTSPR--FVPFPLRYACEFLLQVFGIQLNKEVELAAQAKERHILRTQ-TLL |
| zmphyc2 | LWGLV-VCHHTSPR--FVPFPLRYACEFLLQVFGIQLSKEVELAAQAKERHILRTQ-TLL |
| lephye | LWGLI-VCHHTSPR--YVPFPLRYACEFFTQAFGLQLNMELQLASQLAEKKTLQMQ-TLL |
| atphye | LWGLV-VGHHCSPR--YVPFPLRYACEFLMQAFGLQLQMELQLASQLAEKKAMRTQ-TLL |
| inphye | LWGLV-VCHHTSPR--YVPFPLRYACEFLMQAFSLQLYMELQLASQLAEKKILQTQ-TLL |
| lephyf | LWGLV-VCHHTCPR--FLSFPLRYASEFLLQVFSVQVNKEVEMAAQLKEKQILQIQ-TVL |
| acvphy1 | LWGLV-VCHHTSPR--YVPFPVRSACEFLMQVFSLQLNMEVGMAAQVREKRILRTQ-TLL |
| acvphy2 | LWGLV-VCHHTTPR--AVPFALRSACEFLMQVFGLQLNMELELAAQMREKHILRTQ-TLL |
| acvphy3 | LWGLV-VCHHPSPR--TVSYPLRCACEKLMVAFGVQLNIELDLAAQLRENHILTTQ-ALL |
| apphy1 | LWGLV-VCHHTTPR--AVPFPLRSACEFLMQVFGLQLNMEVELAAQMREKHILRTQ-TLL |
| cpphy2 | LWGLV-VCHHTSPR--TVPFPLRSACEFLMQVFGMQLNMEVELAAQLREKHILRTQ-TLL |
| mcphy1 | LWGLV-VCHHSSPR--YVPFPLRSACEFLMQVFGLQLNMEVELSSQLREKHILRTQ-TLL |
| mpphy1 | LWGLV-VCHHTTPR--SVPFPLRSACEFLMQVFGLQLNMEVELAAQLREKRILRTQ-TLL |
| msphy1 | LWGLI-VCHHSTPR--HIPFPIRSACEFLMQVFGLQLNMEVELAAQHREKHILRTQ-TLL |
| paphy1 | LWGLV-VCHHTSPR--VIPFPLRYACEFLMQVFGIQLNKEVELAAQLREKHILRVQ-PVL |
| ppphy0 | LWGLV-VCHHTSPR--TVPFPLRSACGFLMQVFGLQLNMEVESAAQLREKHILRTQ-TLL |
| ppphy1 | LWGLV-VCHHTSPR--TVPFPLRSACGFLMQVFGLQLNMEVELAAQLREKHILRTQ-TLL |
| ppphy2 | LWGLV-VCHHTSPR--TVSFPLRSACEFLMQVFGLQLNMEVELAAQLREKHILRTQ-TLL |
| ppphy3 | QWGLV-VCHHTSPR--TVPFPLRSACEFLMQVFGLQLNMEVELAAQLREKHILRTQ-TLL |
| ppphy4 | LWGLV-VCHHTSPR--TVSFPLRSACEFLMLVFGLQLNMEVELAAQLREKHILRTQ-TLL |
| psphy1 | LWGLV-VCHHTSPR--AVPFPLRYACEFLMQALGLQLNMELQLAAQLTEKHILRTQ-TLL |
| smphy1 | LWGLV-VCHHTSPR--SVPF-LRSACEFLMQVFGLQLNMEAAVAAHVREKHILRTQ-TLL |
| aphA | LWGLI-ACHHLSAK--YVSYELRKACEFLGRVIFAEISAREE-TEDYDYRMNLTHI-QSL |
| cph1 | LWGLI-ACHHQTPK--VIPFELRKACEFFGRVVFSNISAQED-TETFDYRVQLAEH-EAV |
| cwCph1 | LWGLI-ACHHLTPK--YVPYELRKACEFLGQVVFSEISAKEE-TKDYDYRMKLTRI-QGA |
| npCph1 | LWGLI-ACHHQSPK--YVSYELRKACEFLGRVIFAEISAREE-TEDYYHRINLTHL-QSI |
| cwCph1a | LWGLI-ACHHYSPK--YVIYEIRKICELLGEIFSLKLMYEEE-KSFRQYRQTIKEI-KKR |
| npCph1a | LWGLI-SCHHQTPK--YISYEVRKMCEFLGQIVSSELAHKIS-SSEWDYKVKLKSL-QSE |
| toCphA | LWGLI-ACHHQTPK--YVSYEFRKACEFLGRVIFTEISTREE-TEDYDYRMNLAYI-QTV |
| aphB | LWGLI-ACHHQSPK--YIPYEIRSACEFLGQMTSVEMSAKED-SEDTEDKIQVKSV-HSK |
| atBphP1 | LWGLI-ACHHATPH--SVSLAVREACDFAAQLLSMRIAMEQS-SQDASRRVELGHI-QAR |
| atBphP3 | LWGLI-ACHHATPH--SVSLAVREACDFAAQLLSMRIAMEQS-SQDASRRVELGHI-QAR |
| avAphB | LWGLI-ACHHQSPK--YIPYEIRSACEFLGQMTSVEMSAKED-SEDTEDKIRVKSV-HSK |
| chBphP1 | LWGLV-ACHHYSPK--YLHYETKLAAKLQGHFITSQIEIREQ-NEQYATSQKLHQAVDDL |

-continued

| Name/ SEQ ID No | Sequence |
|---|---|
| chBphP2 | LWGLI-ACHHREKK--FLNFDQCSVFEMFSNVVSTRLSALET-EQNLTKTTENQALMNSI |
| drbphp | LWGLI-ACHHQTPY--VLPPDLRTTLEYLGRLLSLQVQVKEA-ADVAAFRQSLREH-HAR |
| goBphP | LWGLI-ACHNATPR--CLSEDIRAACRTLAGVMSRQLRNKEE-LVTYQERLRLRNA-MEF |
| krBphP | LWGLV-ACHHYSGA-HRPGYDAQSAAEFLSQTASQLIGERARSQERDGALAAQELL-SDI |
| mmBphP2 | LWGLI-ACHHPEPK--PLSLDVRQQLVKIARDFSVGLLVYIA-SIHLKFIDGIQRE-VRT |
| paBphP | LWGLF-SCHHMSPK--LIPYPVRMSFQIFSQVCSAIVERLEQ-GRIAELLRVSTER-RLA |
| pfBphP | LWGLI-SCGNRQPL--HVPHELRTACQTIGQVLSLQISAMEA-LEVSRQREEKLEA-LAL |
| ppBphP1 | LWGMI-ACHHYAPR--TLAMGQRVAAEMFGEFFSLHIETLRS-RQKLEAAVRIHKA-LDS |
| ppBphP2 | LWGLI-SCHHQQPR--PVDLRTRTACELLASVLSLQIESRES-HASTRKLLTLRQH-IVR |
| ppkBphP2 | LWGLI-SCHHQQPR--PVDLRTRTACELLASVLSLQIESRES-HASTRKLLTLRQH-IVR |
| psBphP1 | LWGLI-SCGHRTPL--YVSHELRSACQAIGQVLSLQISAMEA-LEVSRQRETKIQT-LQQ |
| psBphP2 | LWGLI-TCSHPEPL--LVSRELRDACAMIGQLLSVKISAIVA-THIQREREEKVVL-LGQ |
| pssBphP1 | LWGLI-SCGNRTPL--YVSHELRSACQAIGQVLSLQISAMEA-LEISRQREAKVRA-LEQ |
| pssBphP2 | LWGLV-ACGHPEPL--RVSRELRDACAMIGQLLSVKISAIVA-TNIQREREEKVVL-LGQ |
| pstBphP1 | LWGLI-SCGHRTPL--YVSHELRSACQAIGQVLSLQISAMEA-LEVSRQRETKIQT-LQQ |
| rcPpr | LWGMV-AAHHRQPH--HVAIPRRSAAMTVVEAVALSIAAVER-AEAMRGRQVDHAV-LTA |
| rlBphP | LWGLF-ACHHYGPR--LPSAQSRSTAELFGQMFASRLESRER-RLALDYETKARRI-ADR |
| atBphP2 | LWGLI-ACHHYSPR--VLSMPVRIAAEMFGEFFSMHLQVLKQ-KRRLDTINHAHAA-LDR |
| brBphP | LWGLI-ACHHYEPR--FVPFDIRAAGEALAETCAIRIAALES-FAQSQSELVVRRL-EQR |
| rpBphP1N | LWGLV-ACHHYLPR--FIHFELRAICELLAEAIATRITALES-FAQSQSELFVQRL-EQR |
| rpBphP2N | LWGLI-ACHHRKPN--YVDLDGRQACELVAQVLAWQIGVMEE-QAITRQTLKGQAI-QRS |
| rpBphP3N | LWGMI-SCHNLTPR--FVSYEVRQACELIAQVLTWQIGVLEE-AEIVRHSVRMRAI-QNR |
| rpBphP4N | LWGLI-VCHHATPR--FLPYRMREACALFAEMASLQLETRLA-ADQLAARLRSTRI-HEE |
| rpBphP5N | LWGLISAMHHAAPR--HISHQMRMAAEFLAHTLSLLMSAKED-AEQFERSSARKAA-AEA |
| rpBphP6N | LWGLI-ACHHYEPR--AVPMAQRVAAEMFADFFSLHFTAAHH-QRRFQSSLRTRRT-LDS |
| rrBphP | LWGLV-ACHDRVPR--RLSLATMGACQVYAETIAQQVLRLDN-TRRSRHRSRTGDL-IDD |
| rsBphP1 | LWGML-VCHNTTPR--IAGPEWRAAAGMIGQVVSLLLSRLGE-VENAAETLARQST-LST |
| rsBphP1a | LWGML-VCHNTTPR--IAGPEWRAAAGMIGQVVSLLLSRLGE-VENAAETLARQST-LST |
| toCphB | LWGLI-ACHHESPK--YVPYEIRSACEFLGQMTSLELAAKED-SENTEYKMQLKAV-QSK |
| xaBphP | LWGLI-SCHHYSPH--FTSHAMRDATDAVTRALAGRIGALQA-VGRARLESVLLTI-REK |
| xcBphP | LWGLI-SCHHYSPH--FTNHAMRDVTDAVARTLAGRIGALQA-VARARLESVLLTV-REK |
| anFPH1 | LWGLI-SCHSYGPRGMRVSFPIRKMCRLIGDTVSRNIERLSY-ASRLQARKLINTV-P-- |
| bfFPH2 | LWGLI-ACHGYGSHGTRVTLPMRELARNIGECASTNIERLLM-RQRIEARRAPRQN-P-- |
| chFPH1 | LWGLI-ACHTYGPRGMRVSFPIRKMCRMIGDSASRNIERLSY-ASRLQARKLINTV-P-- |
| cnFPH1 | LWGLI-ACHSYGQHGMRVSFPVRQMLRLLSDSISRNIERLSY-AQRLHTRKLISTI-P-- |
| gmFPH1 | LWGLI-SCHSYGNHGMRVSFPIRKMCRLVGDTASRNIERLSY-ASRLQARKLINTA-P-- |
| gzFPH1 | LWGLI-SCHSYGNHGMRVSFPIRKMCRLVGDTASRNIERLSY-ASRLQARKLINTA-PT- |
| ncFPH1 | LWGLV-SCHSYGPKGMRVSFPIRKMCRLIGDTASRNIERLSY-ASRLQARKLINTV-P-- |
| ncFPH2 | LWGLI-VCHSYGPAATRVPFSIRELSFFVGLAASTCLQKLLN-SERLQAHRIIETL-R-- |

-continued

| Name/ SEQ ID No | Sequence |
|---|---|
| umFPH1 | LWGLI-SLHNYGAHGKRVSFPIRQLLRLIGESVSSNIERLSY-TRRLSARKLINTL-P-- |
| aphC | LWGLL-VSHHSENR--TVSEDELEAMQMIVDQLAVAIAQSHLLTQARKKAQKEAII-NRI |
| cph2 | LWGIM-AVHHSKPR--RFTEQEWETMALLSKEVSLAITQSQLSRQVHQQQVQEALV-QRL |
| npCph2a1 | LWGLL-VSHNSEAR--LISEYELEAVQMVVEQLSVAIAQSSLLTQVRKTAERETII-NRI |
| npCph2a2 | LWGLL-VSHHSQAR--VVTQQELLLIQSVVDQVAIAISQSILLTQVREQARQEAII-NKV |
| npCph2b | LWGLL-VSHQSKPR--KILKREIKVLQQVADQVAIAIAQSNLLTAALTQQKQEATI-NRV |
| arphyA | CDMLMRD--------------------------------------APLGIVSQS------ |
| asphya3 | SDMLFRE-------------------------------------ASPLTIVSGT------ |
| asphya4 | SDMLFRE-------------------------------------ASPLTIVSGA------ |
| atphya | CDMLMRD--------------------------------------APLGIVSQS------ |
| cpphya | CDMLMRD--------------------------------------APLGIVSRS------ |
| cupphya | CDILLRD--------------------------------------AVLGIVSQSQS---- |
| gmphya | LCMLMRD--------------------------------------APLGIASES------ |
| lephya | CDMLMRD--------------------------------------APLGIVSQS------ |
| lsphya | CDMLMRD--------------------------------------APLGIVSQS------ |
| mgphya | CDMLMRD--------------------------------------APLGIVSQS------ |
| ntphya | CDMLMRV--------------------------------------APLGIVSQS------ |
| omphya | CDLLLRD--------------------------------------VPLGIVSQS------ |
| osphya | SDMLLRE-------------------------------------SSPLSIVSGT------ |
| pcphya | CDLLMRD--------------------------------------APLGIVSQS------ |
| psphya | CDMLMRD--------------------------------------APLGIVSQS------ |
| sbphya | SDMLFKE-------------------------------------ASPLSIVSGS------ |
| slphya1 | CDMLIRD--------------------------------------APLGIVTHS------ |
| slphya3 | CDMLMRD--------------------------------------APLGIVTQN------ |
| slphya4 | CDMLMRD--------------------------------------APLGIVTQN------ |
| stphya | CDMLMRD--------------------------------------APLGIVSQS------ |
| taphya | SDMLFKE-------------------------------------ASPLTIVSGA------ |
| zmphya1 | SDMLFKE-------------------------------------SSPLSIVSGS------ |
| atphyb | CDMLLRD--------------------------------------SPAGIVTQS------ |
| atphyd | CDMLLRD--------------------------------------SPAGIVTQR------ |
| gmphyb | CDMLLRD--------------------------------------SPTGIVTQS------ |
| lephb1 | CDMLLRD--------------------------------------SPPGIVTQS------ |
| lephb2 | CDMLLRD--------------------------------------SPTGIVTQN------ |
| npphyB | CDMLLRD--------------------------------------SPTGIVTQS------ |
| ntphyb | CDMLLRD--------------------------------------SPTGIVIQS------ |
| osphyb | CDMLLRD--------------------------------------SPTGIVTQS------ |
| pbphyb1 | CDMLLRD--------------------------------------SPTGIVTQS------ |
| pbphyb2 | CDMLLRD--------------------------------------SPTGIVTQS------ |

-continued

| Name/ SEQ ID No | Sequence |
|---|---|
| sbphyB | CDMLLRD--------------------------------------SPTGIVTQS------ |
| slphyb | CDMILRE--------------------------------------SPTGIVTQS------ |
| stphyb1 | CDMLLRD--------------------------------------SPPGIVTQS------ |
| stphyb2 | CDMLLRD--------------------------------------SPPGIVTQS------ |
| zmphyb1 | CDMLLRD--------------------------------------SPTGIVTQS------ |
| zmphyb2 | CDMLLRD--------------------------------------SPAGIITQS------ |
| atphyc | CDMLFRN--------------------------------------APIGIVTQS------ |
| osphyc | CDMLLRD--------------------------------------APVGIFTQS------ |
| sbphyc | WDMLLRD--------------------------------------APVGIFTQS------ |
| slphyc | CDMLMRD--------------------------------------SPITIITQS------ |
| taphyc | CDMLLRD--------------------------------------APVGIFTQS------ |
| zmphyc1 | CDMLLRD--------------------------------------APVGIFTRS------ |
| zmphyc2 | CDMLLRD--------------------------------------ALVGIFTQS------ |
| lephye | CDMLLRD--------------------------------------VPFGVVTQS------ |
| atphye | CDMLLRD--------------------------------------TVSAIVTQS------ |
| inphye | CDMLLRD--------------------------------------APFGIVTQT------ |
| lephyf | CDMLLRD--------------------------------------APMGIVTQS------ |
| acvphy1 | CDMLLRD--------------------------------------APIGIVSQS------ |
| acvphy2 | CDMLLRD--------------------------------------APIGIVSES------ |
| acvphy3 | CDMLRRI------------------------------------RGAPIGIVSRS------ |
| apphy1 | CDMLLRD--------------------------------------APIGIVSES------ |
| cpphy2 | CDMLLRD--------------------------------------APIGIVSQT------ |
| mcphy1 | CDMLLRD--------------------------------------APMGIVSQS------ |
| mpphy1 | CDMLLRD--------------------------------------APIGIVSQS------ |
| msphy1 | CDMLLRD--------------------------------------APMGIVSQS------ |
| paphy1 | CDMLLRD--------------------------------------APVGIVSQT------ |
| ppphy0 | CDMLLRD--------------------------------------APIGIVSQI------ |
| ppphy1 | CDMLLRD--------------------------------------APIGIVSQI------ |
| ppphy2 | CDMLLRD--------------------------------------APIGIVSQS------ |
| ppphy3 | CDMLLRD--------------------------------------APTGIVSQV------ |
| ppphy4 | CDMLLRD--------------------------------------APIGIVSQS------ |
| psphy1 | CDMLLRD--------------------------------------APMGIVTQS------ |
| smphy1 | CDMLLRD--------------------------------------APIGIVSQS------ |
| aphA | LVEYMSQ-----------------------------------EDNFVDGLIKHQ------ |
| cph1 | LLDKMTT-----------------------------------AADFVEGLTNHP------ |
| cwCph1 | LIESMSQ-----------------------------------ADNFIEGLINSN------ |
| npCph1 | LIEYMSQ-----------------------------------EENFIDGLVKNP------ |
| cwCph1a | IKEELSK--------------------------------NKNKHDFIDNIIQKNG----- |
| npCph1a | FLESISQ-----------------------------------ADNFIDALIKPE------ |

-continued

| Name/ SEQ ID No | Sequence |
|---|---|
| toCphA | LVEYMSQE-----------------------------------ENFIDGLVKHQ------ |
| aphB | LVQYMSA-----------------------------------ENDFINALIDHQ------ |
| atBphP1 | LLKGMAA-----------------------------------AEKWVDGLLGGEGE---- |
| atBphP3 | LLKGMAA-----------------------------------AEKWVDGLLGGEGE---- |
| avAphB | LVQYMSA-----------------------------------ENDFINALIDHQ------ |
| chBphP1 | ISRKFSA-----------------------------------DRNSLKDIVID------- |
| chBphP2 | IEELYSQ------------------------------------TMLINAIDNCA------ |
| drbphp | VALAAAH-----------------------------------SLSPHDTLSDPA------ |
| goBphP | VTSHFEVR-----------------------------------HPIESNLRSFM------ |
| krBphP | TAAVSAS------------------------------------GREPLTTLIEE------ |
| mmBphP2 | MLDSAG------------------------------------HLDLTQGLVRCQ------ |
| paBphP | LARRARD-----------------------------------ADDLFGALAHPD------ |
| pfBphP | LNQAMIDS----------------------------------PQNVFDGLANQP------ |
| ppBphP1 | LLRDANQ------------------------------------AADIDGFFHARL----- |
| ppBphP2 | MISSMAD-----------------------------------HDSVSDGLRDLP------ |
| ppkBphP2 | MISSMAD-----------------------------------HDSVSDGLRDLP------ |
| psBphP1 | LHQMMATS----------------------------------DTDVFDGLAQQP------ |
| psBphP2 | LADAMNRA----------------------------------DHEILHGLVSRP------ |
| pssBphP1 | LNLAMAGS----------------------------------EENVFDGLAQQP------ |
| pssBphP2 | LADAMSRA----------------------------------NHEVLDGLVSRP------ |
| pstBphP1 | LHQMMATS----------------------------------DTDVFDGLAQQP------ |
| rcPpr | LMVQMAS-----------------------------------SDAVEPALTQQA------ |
| rlBphP | LLTSVADN----------------------------------ASLLDDPAWLI------- |
| atBphP2 | FLRLAAH-----------------------------------HANIEELLVDSF------ |
| brBphP | LVEAVSRD-----------------------------------GEWQAALFDGS------ |
| rpBphP1N | MIEAITRE-----------------------------------GDWRAAIFDTS------ |
| rpBphP2N | LINDIEQL-----------------------------------HDHRAGLARNS------ |
| rpBphP3N | LLHELGDE-----------------------------------QGLTAGLSRVS------ |
| rpBphP4N | LVTRMSQE-----------------------------------SDLAEGLIRFY------ |
| rpBphP5N | LTRLLDSE-----------------------------------ADIGAALHAAGAL---- |
| rpBphP6N | LTSEMSF------------------------------------DASVDDFLRGNL----- |
| rrBphP | ISVLLGSG-----------------------------------RSLAEALDYTL------ |
| rsBphP1 | LVERLSTG-----------------------------------DTLAAAFVAAD------ |
| rsBphP1a | LVERLSTG-----------------------------------DTLAAAFVAAD------ |
| toCphB | LVEYMAAA-----------------------------------NNFVDGLIGQE------ |
| xaBphP | LITDFNDA-----------------------------------EHLTVDMLADMA----- |
| xcBphP | LITDFNDA-----------------------------------EHMTVELLDDMA----- |
| anFPH1 | ------------------------------------------TDANPSGYIVASS----- |

-continued

| Name/ SEQ ID No | Sequence |
|---|---|
| bfFPH2 | -----------------------------------------GKTPSGFIAASS----- |
| chFPH1 | ----------------------------------------TQHNPSGYIIASS----- |
| cnFPH1 | ----------------------------------------DRSHPTGYIISNA----- |
| gmFPH1 | ----------------------------------------TDKNPSGYIIASS----- |
| gzFPH1 | -----------------------------------------DKNPSGYIIASS----- |
| ncFPH1 | ----------------------------------------TDKNPSGYIIASS----- |
| ncFPH2 | ----------------------------------------GRGRPDECITSSS----- |
| umFPH1 | ----------------------------------------TDQNPSGYIISNA----- |
| aphC | ITLLHSL----PTIVLKPALEAAVGAFAGVGGRLCLRN----QAVESQHVVLRS------ |
| cph2 | ETTVAQYGD--RPETWQYALETVGQAVEADGAVLYIAP----DLTGSVAQHYQWNLRF-- |
| npCph2a1 | ATLLHSL----PTIVLQPALEAAIAAFNGVGGRLCIRN----EAFDYYNGNLTS------ |
| npCph2a2 | TEQLHST----PVAQLQTALEETVAAFNGSGGRLYLLP-DDEQTAKLYTFGLQPNQLDIG |
| npCph2b | TTLLHKL----PTIQLQGAIEEVITAFSGVGGRLYIE----QSRELYTWGDQPTLPYEL |
| arphyA | ---------PNIMDLVK-CDGAALLYKDKIWKLGTTPS-------EFHLQEIASWLYEYH |
| asphya3 | ---------PNIMDLVK-CDGAALLYGGKVWRLRNAPT-------ESQIHDIAFWLSDVH |
| asphya4 | ---------PNIMDLVK-CDGAALLYGGKVWRLRNAPT-------ESQIHDIAFWLSDVH |
| atphya | ---------PNIMDLVK-CDGAALLYKDKIWKLGTTPS-------EFHLQEIASWLCEYH |
| cpphya | ---------PNIMDLVK-SDGAALLYKKKIWRLGLTPN-------DFQLLDIASWLSEYH |
| cupphya | ---------PNMMDLVK-CDGAVLLYKSKIHRLGITPT-------DFQLQDIVYRLNEHH |
| gmphya | ---------PNIMDLVK-CDGAALIYRNKVWRLGVTPS-------EPQIREIALWLSEYH |
| lephya | ---------PNIMDLVK-CDGAALLYKNKIHRLGMNPS-------DFQLQDIVSWLCEYH |
| lsphya | ---------PNIMDLVK-CDGAALFYRNKLWLLGATPT-------EYQIREIALWMSEYH |
| mgphya | ---------PNVMDLVK-CDGAVLLYKDKTYRMGTTPT-------DFQLRDIVYWLSEYH |
| ntphya | ---------PNIMDLVK-CDGAALLYKNKIHRLGMTPS-------DFQLHDIVSWLSEYH |
| omphya | ---------PNVMDLVK-CDGAILLHKRTKYRLGLTPT-------DFQIRDIVSWLDEYH |
| osphya | ---------PNIMDLVK-CDGAALLYGGKVWRLQNAPT-------ESQIRDIAFWLSDVH |
| pcphya | ---------PNMMDLVK-CDGAALLYKNKVYRLGATPS-------DYQLRDIVSWLTEYH |
| psphya | ---------PNIMDLVK-CDGAALFYRNKLWLLGATPT-------ESQLREIALWMSEYH |
| sbphya | ---------PNIMDLVK-CDGAALLYGDKVWRLQTAPT-------ESQIRDIAFWLSEVH |
| slphya1 | ---------PNIMDLVK-CDGAALLYNNKVWRLGSTPT-------DYQLQEIGGWLSRDH |
| slphya3 | ---------PNVMDLVK-CDGAALLYNNKIWKLGISPT-------DYQLRDIAGWLSRDH |
| slphya4 | ---------PNVMDLVK-CDGAALLYNNKIWKLGITPT-------DYQLRDIAGWLSRDH |
| stphya | ---------PNIMDLIK-CDGAALLYKNKIHRLGMNPS-------DFQLHDIVSWLCEYH |
| taphya | ---------PNIMDLIK-CDGAALLYGGKVWRLGTAPT-------ESQIRDLALWLSEVH |
| zmphya1 | ---------PNIMDLVK-CDGAALLYGDKVWRLQTAPT-------ESQIRDIAFWLSEVH |
| atphyb | ---------PSIMDLVK-CDGAAFLYHGKYYPLGVAPS-------EVQIKDVVEWLLANH |
| atphyd | ---------PSIMDLVK-CNGAAFLYQGKYYPLGVTPT-------DSQINDIVEWLVANH |
| gmphyb | ---------PSIMDLVK-CDGAALYFQGNYYPLGVTPT-------EAQIRDIIEWLLAFH |
| lephb1 | ---------PSIMDLVK-CDGAALYYQRKYYPLGVTPT-------EAQIKDIVEWLLAYH |

-continued

| Name/ SEQ ID No | Sequence |
|---|---|
| lephb2 | ---------PSIVDLVK-CDGAALYYQGRYYPLGITPT-------AAQIKGIVEWLLTCH |
| npphyB | ---------PSIMDLVK-CDGAALYCQGKYYPLGVTPT-------EAQIKDIVEWLLTYH |
| ntphyb | ---------PSIMDLVK-CDGAALYCQGKYYPLGVTPT-------EAQIKDIVEWLLTYH |
| osphyb | ---------PSIMDLVK-CDGAALYYHGKYYPLGVTPT-------EVQIKDIIEWLTMCH |
| pbphyb1 | ---------PSIMDLVK-CDGAALYYQGQYYPLGVTPT-------EAQIKDIVEWLLALH |
| pbphyb2 | ---------PSIMDLVK-CDGAALYYQGQYYPLGVTPT-------ETQIKDIVEWLLTLH |
| sbphyB | ---------PSIMDLVK-CDGAALYYHGKYYPLGVTPT-------ESQIKDIIEWLTVCH |
| slphyb | ---------PSIMDLVK-CDGAALLFCGKYYPLGVTPT-------ELQLKDIVQWLLSNH |
| stphyb1 | ---------PSIMDLVK-CDGAALYYQGKYYPLGVTPT-------EAQIKDIVEWLLAYH |
| stphyb2 | ---------PSIMDLVK-CDGAALYYQGKYYPLGVTPT-------EAQIKDIVEWLLAYH |
| zmphyb1 | ---------PSIMDLVK-CDGAALYYHGKYYPLGVTPT-------ESQIKDIIEWLTVFH |
| zmphyb2 | ---------PSVMDLVK-CDGAALYYRGKYYPLGVTPT-------ESQIKDIIEWLTVCH |
| atphyc | ---------PNIMDLVK-CDGAALYYRDNLWSLGVTPT-------ETQIRDLIDWVLKSH |
| osphyc | ---------PNVMDLVK-CDGAALYYQNQLWVLGSTPS-------EAEIKNIVAWLQEYH |
| sbphyc | ---------PNVMDLVK-CDGVALYYQNQLLLLGSTPS-------ESEIKSIATWLQENH |
| slphyc | ---------PNVMDLVK-CDGAALLYQSKLWVLGITPK-------SNQIKDISQWLFEYH |
| taphyc | ---------PNVMDLVK-CDGAALCYQNQIMVLGSTPS-------EGEIKKIVAWLLECH |
| zmphyc1 | ---------PNVMDLVK-CDGAALYYQNQLLVLGSTPS-------ESEIKSIATWLQDNH |
| zmphyc2 | ---------PNVMDLVK-CDGAALYYQNQVLVLGSTPS-------ESEIKSIATWLQENH |
| lephye | ---------PSIMDLVK-CDGAALYCGGKCWLLGVTPT-------EAQVKDIAQWLLVAH |
| atphye | ---------PGIMDLVK-CDGAALYYKGKCWLVGVTPN-------ESQVKDLVNWLVENH |
| inphye | ---------PSIMDLVR-CDGAALYYNGKCWLLGVTPT-------ETQVKDIAEWLLHNH |
| lephyf | ---------PNVMDLVK-CDGAALYYRNKLWLHGVTPA-------ESQIRDIAEWLNESH |
| acvphy1 | ---------PNIMDLVT-CDGAALYYGKKCWLLGTTPT-------EAQIVDIAAWLLDCH |
| acvphy2 | ---------PNIMDLVK-CDGAALYYGKNFWLLGTTPI-------EAQIKDLAEWLLDVH |
| acvphy3 | ---------PSIMDLVK-CDGAALYYGGRFWPLGTTPS-------EFQIRDLAEWLLGAS |
| apphy1 | ---------PNIMDLVK-CDGASLYYGKKFWLLGTTPT-------EAQIKDLADWLLEVH |
| cpphy2 | ---------PNIMDLVK-CDGAALYYGKRFWLLGTTPT-------ENQIKDIAEWLLEYH |
| mcphy1 | ---------PNITDLVK-CDGAALFYHGRAWLLGVTPS-------EAQVRDIAAWLLDSH |
| mpphy1 | ---------PNIMDLVK-CDGAALYYGKRYWVLGTTPT-------ELQIKDIADWLLEYH |
| msphy1 | ---------PNVMDLVK-CDGAALLFGGRCWLLGISPT-------QEQVKDIATWLISSH |
| paphy1 | ---------PNIMDLVK-CDGAALLYGKRLWLLGTTPT-------EAQILDIADWLLEHH |
| ppphy0 | ---------PNIMDLVK-CDGAALYYGKPFWLLGTTPT-------ESQIKDIAEWLLEYH |
| ppphy1 | ---------PNIMDLVK-CDGAALYYGKRFWLLGTTPT-------ESQIKDIAEWLLEYH |
| ppphy2 | ---------PNIMDLVK-CDGAALHYGKRFWLLGITPN-------DAQIKEIADWLLEHH |
| ppphy3 | ---------PNIMDLVK-CDGAALYYGKRFWLLGTTPT-------ESQIKDIAEWLLEYH |
| ppphy4 | ---------PNIMDLVK-CDGAALYYGKRFWLLGITPN-------EVQIKEIADWFLEHH |
| psphy1 | ---------PSIKDLVK-CDGAALYYGGMCWMLGVTPT-------EAQIKDIADWLLEHH |

-continued

| Name/<br>SEQ ID No | Sequence |
|---|---|
| smphy1 | ---------PNIMDLVK-CDGAALYYGKRFWLLGITPS-------EAQIKDIAEWLLEHH |
| aphA | ---------PSLLDLTS-AQGAAVCFGDHCTLIGETPK-------AEDLVFLVQWLKNNV |
| cph1 | ---------DRLLGLTG-SQGAAICFGEKLILVGETPD-------EKAVQYLLQWLENRE |
| cwCph1 | ---------QNLLDLTS-SQGVAVCVGEEYNLIGNTPK-------EEEVKYLLQWLKKNI |
| npCph1 | ---------QHLLDLAS-AQGAAVCFAGNCTVVGETPR-------EEDLNFLVQWLKNNV |
| cwCph1a | ---------DSFLKLIS-ARGIAICLDNKIYVKGNTPK-------KKQIKALINDFLLPK |
| npCph1a | ---------IRLLDFVS-ASGAAVCLDNEINLVGTTPN-------IDEVRALIEWADTQV |
| toCphA | ---------PNLLNLTS-AQGAAVCFGDRCTVIGQTPK-------EEDLNFLLQWLKNNV |
| aphB | ---------PNILDLVK-AQGAAVCFNGNSCTVGQVPP-------MPDIQVLVEWMSQNI |
| atBphP1 | --------REDLLKQVG-ADGAALVLGDDYELVGNTPS-------REQVEELILWLGERE |
| atBphP3 | --------REDLLKQVG-ADGAALVLGDDYELVGNTPS-------REQVEELILWLGERE |
| avAphB | ---------PNILDLVN-AQGAAVCFNGNFRTVGQVPP-------IPDIQVLVEWMSQNI |
| chBphP1 | ---------SNVLQLCKAAGISILIDKKEVYKSGLTPA-------DGDIQKLAEYVKHAI |
| chBphP2 | ---------ALIMQLLD-CTGLVHIRESKVKSFGACPS-------ASSIHELVIWLQMKN |
| drbphp | ---------LDLLGLMR-AGGLILRFEGRWQTLGEVPP-------APAVDALLAWLETQP |
| goBphP | ---------GELQSLFP-CNGFAVISDQTITGTGVLPD-------AENLHRLHDWLRLGT |
| krBphP | ---------PRLLQLLD-AGGAALWTGHELLTSGQVPP-------SAQLRRIAALLARAD |
| mmBphP2 | ---------DRFLALVG-ADSAAILTDDSVIRLGDAPA-------TDDLALIDHWFDSQD |
| paBphP | ---------DGIAALIP-CDGALVMLGGRTLSIRGDFE--------RQAGNVLQRLQRDP |
| pfBphP | ---------QVLMALAN-AGGIAIIEDKQLHRYGNCPE-------PEEIRALHKWLQERG |
| ppBphP1 | ---------PRLMSLIP-CDGIGMSLLGRWSCAGLAPP-------QTAVPDLLRLADMVS |
| ppBphP2 | ---------EVLLAFAD-AQGAAVISAERCDLIGQTPP-------EAQVTALVHWLGQRD |
| ppkBphP2 | ---------EVLLAFAD-AQGAAVISAERCDLIGQTPP-------EAQVTALVHWLGQRD |
| psBphP1 | ---------QLLMDLVG-ATGVAIIEDRQTHCYGNCPE-------PSDIRALHTWMMAGG |
| psBphP2 | ---------QLLQALTQ-ADGAAVLIDDQVHLFGQCPT-------SEEVRALYQWIRDTG |
| pssBphP1 | ---------QLLMDLVG-ATGVAIIEDRQTHCFGICPE-------PSDIRALHAWMIAGG |
| pssBphP2 | ---------ELLMSLTL-ADGAAVLIDDQVYLFGTCPS-------IEQVRELYTWIRDTG |
| pstBphP1 | ---------QLLMDLVG-ATGVAIIEDRQTHCYGNCPE-------PSDIRALHTWMMAGG |
| rcPpr | ---------TRLTDLFG-ATGAALSIDGHLLTVGDWPP-------PAEVAALRAWLEPRW |
| rlBphP | ---------EALADAIP-ADGIGVWINGRLALAGIGPD-------ERSFAALVRHLNRNA |
| atBphP2 | ---------QDFADLMP-CDGVGLWVGNNWHGHGATPP-------HDAIPRLARFVASAS |
| brBphP | ---------QSLLQPLG-ASGAALLFEGQVMTAGDVPS-------TQRIRDLATWLDRRR |
| rpBphP1N | ---------QSILQPLH-ADGCALVYEDQIRTIGDVPS-------TQDVREIAGWLDRQ- |
| rpBphP2N | ---------EALLELMG-ASGLCLHSREGVITIGQTPP-------GPIIDQLAQLAGRSG |
| rpBphP3N | ---------EEMLALMG-ASGFALCSFDGVAAFGRTPS-------DDEIQALASWLSHRE |
| rpBphP4N | ---------PNLLDFIP-AAGVGLWIDGQFTGIGATPG-------PAQVAAMMGWLHGVP |
| rpBphP5N | ---------DLLSALID-AGGVVVQTGDEVATRGEAPA-------AAPLHELTSWLRERA |
| rpBphP6N | ---------KRIADLIP-SDGVGLWMNGVWTAHGSTPP-------ADALPSILHLLTGRA |
| rrBphP | ---------DDTLALFGASRAVISLDGRQWTAEGPLEG------APIQVPPHQRLLLSER |

-continued

| Name/<br>SEQ ID No | Sequence |
|---|---|
| rsBphP1 | ---------QLILDLVG-ASAAVVRLAGQELHFGRTPP-------VDAMQKVLDSLGRPS |
| rsBphP1a | ---------QLILDLVG-ASAAVVRLAGQELHFGRTPP-------VDAMQKVLDSLGRPS |
| toCphB | ---------PNLLDLVN-ATGAAVCINGEYQTLGRTPQ-------HREIEQLINWLSQHT |
| xaBphP | ---------PDLMDVVD-ADGVAIFHGNEISRHGSVPD-------AEALRRIREHLESEH |
| xcBphP | ---------PDLMDVVD-ADGVAIFHGNDISRHGTTPD-------VAALRRIRDHIESEH |
| anFPH1 | ---------DDLLRLVD-ADYGALCIRGEVKILAKSPQ-------SQEMLALLEYLKVRK |
| bfFPH2 | ---------DDLLKVFD-ADFGLLNIQDEARAIGRLRP-------YREALSILAYLQSRH |
| chFPH1 | ---------DDLLKLFN-ADFGLLSIRDETKILGTLEN-------SQESLAMLEYLRMRR |
| cnFPH1 | ---------GDLLQIFG-ADAGLLVIGDGCKLLGHSNEQ------GQAMLAIAEYLRIKR |
| gmFPH1 | ---------EDLLKLFD-ADFGLLSIKGETKIMGLVEQ-------SQEALAMLEYLRMRQ |
| gzFPH1 | ---------EDLLKLFD-ADFGLLSIKGETKLMGPVEQ-------SQEALAMLEYLRMRQ |
| ncFPH1 | ---------DDLLKLFN-ADFGMLSIREETKILGKIEQ-------SQEALAMLEYLRLRK |
| ncFPH2 | ---------HELLNLFD-CDCGFLVIEGEARTIGRLSS-------YIEAITLLKYLFFRG |
| umFPH1 | ---------EDLLTLFD-ADYGVIAVGNEAKILGPLNA-------SQEVLAVTEFLRLKK |
| aphC | ----------LAECLIP-GSNCVQLYTCGQQPITPEQT------IYPLIEQYRVWQEHYT |
| cph2 | ---------DWGNWLET-SLWQELMRGQPSAAMEPMAA------VQSTWEKPRPFTSVAP |
| npCph2a1 | ----------LTECLIP-GNTCIKLFICGQQPVMPEQT------IYPLIEQYSIWQEHYK |
| npCph2a2 | QEQTPSPLTQELSLVDR-AWVSPMERNNEVLLLANLREGSDVLRKGRPIEEHRLWQKYLF |
| npCph2b | --------DSSIIEQHP-TWQNWMTECQP------------------------------- |
| arphyA | T-------------------------------------DSTGLSTDSLYDAGFPKALSLG |
| asphya3 | R-------------------------------------DSTGLSTDSLHDAGYPGAAALG |
| asphya4 | R-------------------------------------DSTGLSTDSLHDAGYPGASALG |
| atphya | M-------------------------------------DSTGLSTDSLHDAGFPRALSLG |
| cpphya | M-------------------------------------DSTGLSTDSLYDAGYPGAIALG |
| cupphya | M-------------------------------------DSTGLSTDSLYDAGFPGALSLG |
| gmphya | M-------------------------------------DSTSFSTDSLFDAGFPSALSLG |
| lephya | T-------------------------------------DSTGLSTDSLYDAGFPGALALG |
| lsphya | T-------------------------------------DSTGLSTDSLLDAGFPGALSLS |
| mgphya | T-------------------------------------DSTGLSTDSLYDAGYPGALAFG |
| ntphya | T-------------------------------------DSTGLSTDSLYDAGFPGALALG |
| omphya | Q-------------------------------------DSTGLSTDSLYDAGFPGALALG |
| osphya | R-------------------------------------DSTGLSTDSLHDAGYPGAAALG |
| pcphya | T-------------------------------------DSTGLSTDSLYDAGYPGALALG |
| psphya | T-------------------------------------DSTGLSTDSLSDAGFPGALSLS |
| sbphya | G-------------------------------------DSTGLSTDSLQDAGYPGAASLG |
| slphya1 | M-------------------------------------DSTGLSTDSLYDAGYPAALELG |
| slphya3 | T-------------------------------------DSTGLSTDSLHDAGYPGARSLG |
| slphya4 | T-------------------------------------DSTGLSTDSLHDAGYPGARSLG |

-continued

| Name/ SEQ ID No | Sequence |
|---|---|
| stphya | T-------------------------------------DSTGLSTDSLYDAGFPGALALG |
| taphya | M-------------------------------------DSTGLSTESLHDAGYPGASALG |
| zmphya1 | G-------------------------------------DSTGLSTDSLQDAGYPGAASLG |
| atphyb | A-------------------------------------DSTGLSTDSLGDAGYPGAAALG |
| atphyd | S-------------------------------------DSTGLSTDSLGDAGYPRAAALG |
| gmphyb | G-------------------------------------DSTGLSTDSLGDAGYPGLPRLG |
| lephb1 | G-------------------------------------DSTGLSTDSLADAGYPGAASLG |
| lephb2 | V-------------------------------------DSTGLSTDSLADAGYPEAASLG |
| npphyB | G-------------------------------------DSTGLSTDSLADAGYPGAALLG |
| ntphyb | G-------------------------------------DSTGLSTDSLADAGYPGAALLG |
| osphyb | G-------------------------------------DSTGLSTDSLADAGYSGAADLG |
| pbphyb1 | G-------------------------------------DSTGLSTDSLADAGYPGAASLG |
| pbphyb2 | G-------------------------------------DPTGLSTDSLADAGYPGAAFLG |
| sbphyB | G-------------------------------------DSTGLSTDSLADAGYLGAAALG |
| slphyb | G-------------------------------------DSTGLSTDSLADAGYPGALALA |
| stphyb1 | G-------------------------------------DSTGLSTDSLPDAGYPGAASLG |
| stphyb2 | G-------------------------------------DSTGLSTDSLPDAGYPGAASLG |
| zmphyb1 | G-------------------------------------DSTGLSTDSLADAGYLGAAALG |
| zmphyb2 | G-------------------------------------DSTGLSTDSLADAGYLGAVALG |
| atphyc | G-------------------------------------GNTGFTTESLMESGYPDASVLG |
| osphyc | D-------------------------------------GSTGLSTDSLVEAGYPGAAALG |
| sbphyc | D-------------------------------------GSTGLSTDSLVEAGYPGAAALR |
| slphyc | G-------------------------------------NTKGLITDSLKEAGYPGALELG |
| taphyc | D-------------------------------------GSTGLSTGLTLEAGYPGASALG |
| zmphyc1 | D-------------------------------------GSTGLSTDSLVEAGYPGAVALR |
| zmphyc2 | D-------------------------------------GSTGLSTDSLVEAGYPGAAALR |
| lephye | K-------------------------------------DSTGLSTDCLADAGYPGAALLG |
| atphye | GD------------------------------------DSTGLTTDSLVDAGYPGAISLG |
| inphye | G-------------------------------------DSTGLSTDCLSDAGYPGAPLLG |
| lephyf | G-------------------------------------DSTGLNTDSLMEAGFPGASVLG |
| acvphy1 | K-------------------------------------DSTGLSTDSLAKTGYPEASCLG |
| acvphy2 | R-------------------------------------DSTGLSTDSLADAGYPGAAALG |
| acvphy3 | EEIA----------------------------------STGVTCTDSLAEMGYPGAALLG |
| apphy1 | K-------------------------------------DSTGLSTDSLADAGYPGATALG |
| cpphy2 | K-------------------------------------DSTGLSTDSLADANYPGAHLLG |
| mcphy1 | K-------------------------------------DSTGLSTDSLADAGYPNADSLG |
| mpphy1 | K-------------------------------------DSTGLSTDSLADAGYPGAASLG |
| msphy1 | T-------------------------------------DTTGLSTDSLVDAGYPKARELG |
| paphy1 | R-------------------------------------DSTGLSTDSLAEAGYPGAASLG |

-continued

| Name/ SEQ ID No | Sequence |
|---|---|
| ppphy0 | K-------------------------------------DSTGLSTDSLADANYPAAHLLG |
| ppphy1 | K-------------------------------------DSTGLSTDSLADANYPAAHLLG |
| ppphy2 | Q-------------------------------------DSTGLSTDSLADAGYPGAAQLG |
| ppphy3 | K-------------------------------------DSTGLSTDSLADANYPAAHLLG |
| ppphy4 | Q-------------------------------------DSTGLSTDSLADAGYPGAAQLG |
| psphy1 | G-------------------------------------DSTGLSTDSLADAGYPGAASLG |
| smphy1 | K-------------------------------------DSTGLSTDSLADAGYPGAASLG |
| aphA | EE---------------------------------------EVFYTDSLPQVYPDAERYK |
| cph1 | VQ---------------------------------------DVFFTSSLSQIYPDAVNFK |
| cwCph1 | DE---------------------------------------EVFSTPSLPHLYADARNFK |
| npCph1 | EE---------------------------------------EVFYTDSLPQIYPDAESFK |
| cwCph1a | KK-------------------------------------DVFLQIFSQSHILFPEKLKKL |
| npCph1a | TD---------------------------------------NLFSTDSLPKLYPEALIFK |
| toCphA | RE---------------------------------------EVFYTDSLPRIYPDAEKFK |
| aphB | HE---------------------------------------EIFATDSLATVYPDAEKLR |
| atBphP1 | IA---------------------------------------DVFATDNLAGNYPTAAAYA |
| atBphP3 | IA---------------------------------------DVFATDNLAGNYPTAAAYA |
| avAphB | HE---------------------------------------EIFATDSLATVYPDAEKLR |
| chBphP1 | DK---------------------------------------EQYATHFITAELPDFKNIT |
| chBphP2 | FT---------------------------------------TLYATAALTEAYEDAAAIA |
| drbphP | G----------------------------------------ALVQTDALGQLWPAGADLA |
| goBphP | NG---------------------------------------GIFVSTMLGKDYPPAAEWP |
| krBphP | G----------------------------------------APTFTDHLPTLDPGLAEVA |
| mmBphP2 | GK---------------------------------------GFASTAHLAAQIPEAETFR |
| paBphP | ER---------------------------------------DIYHTDNWPQPSEDSPDGG |
| pfBphP | EP----------------------------------------VFASHHLASVYPPAAHYQ |
| ppBphP1 | EG---------------------------------------RIWASNRLSTVLPSAQAYF |
| ppBphP2 | ED---------------------------------------KVFHSDNLRRDITELPELA |
| ppkBphP2 | ED---------------------------------------KVFHSDNLRRDITELPELA |
| psBphP1 | EP----------------------------------------VYASHHLSSVYPPGEAYQ |
| psBphP2 | LTRQRSKERATG-------------------------LQGLGVFHTDSMQRERPESAAYR |
| pssBphP1 | EP----------------------------------------VYASHHLSSVYAPAEAYQ |
| pssBphP2 | LASQRSRQRATG-------------------------LQGLGVFHTNSMQRELADSAVYR |
| pstBphP1 | EP----------------------------------------VYASHHLSSVYPPGEAYQ |
| rcPpr | G--------------------------------------SAGLFRTSSLSSVFPDATAYR |
| rlBphP | AG---------------------------------------RIYAVDRLAETYPDLEVD- |
| atBphP2 | EG---------------------------------------RVWATHALSQAIPEAEIYA |
| brBphP | KAPDA---------------------------------PPQGLTVTASLTLDDPSFADIR |

-continued

| Name/<br>SEQ ID No | Sequence |
|---|---|
| rpBphP1N | --------------------------------------PRAAVTSTASLGLDVPELAHLT |
| rpBphP2N | GS---------------------------------------ELFQTDRLSTIIPEAGAFA |
| rpBphP3N | SR---------------------------------------GIFQTQQLSASFPEAEVYS |
| rpBphP4N | HD---------------------------------------GVYHTDCLALAYPPAKAFA |
| rpBphP5N | R----------------------------------------PVFATDRLPNLDPAAQAVA |
| rpBphP6N | GN---------------------------------------EIVATHALTDRIAAATDYA |
| rrBphP | LG--------------------------------------GRLRLPAELAGSFV------ |
| rsBphP1 | P---------------------------------------LEVLSLDDVTLRHPELPELL |
| rsBphP1a | P---------------------------------------LEVLSLDDVTLRHPELPELL |
| toCphB | QE---------------------------------------EVFHTNCLSELLPEASEWK |
| xaBphP | HDALR--------------------------------EDAVGALHVDAIGEVFPELADLA |
| xcBphP | HDALR--------------------------------EDAVGALHVDAIGEVFPELADLA |
| anFPH1 | YN---------------------------------------SVLTSNHIVKDFQDLNYPP |
| bfFPH2 | FT---------------------------------------EIFSTHNITKDLPKLKDSP |
| chFPH1 | IQ---------------------------------------AVMTSTDIATDFPDLRYPP |
| cnFPH1 | FD---------------------------------------NLNASSSIQRDFPDLVLPR |
| gmFPH1 | LT---------------------------------------SVVASQDVKEDFPDLRYPP |
| gzFPH1 | LT---------------------------------------SVVASQDVSEDFPDLRYPP |
| ncFPH1 | FS---------------------------------------SVVTSQDIKIDFPDLRYPP |
| ncFPH2 | SR---------------------------------------TILFSHNIGDDFKDLHFPS |
| umFPH1 | FE---------------------------------------HLVTSQDVHRDFPDMVLST |
| aphC | S------------------------------------HHDIWAIADIYQDSTLRSLQAVF |
| cph2 | LPPTN-------------------------------CVPHGYTLGELEQRSDWIAPPESL |
| npCph2a1 | SG-----------------------------------KYDVWAISDLYNSPDLRSLQVAF |
| npCph2a2 | ASICPPENLENPSHKSWSVNWMRAIYALTPPVNELSYDSNLWAIADLYKEPLLRSVAPCF |
| npCph2b | --------------------------------------GNIWATSDLYKEPHLRVLALAF |
| arphyA | DAVC--GMAAVRIS------SKDMIFWFRSHTAGEVRWGGAKHDPD-----DRDDARRMH |
| asphya3 | DMIC--GMAVAKIN------SKDILFWFRSHTAAEIRWGGAKNDPS-----DMDDSRRMH |
| asphya4 | DMIC--GMAVAKIN------SKDIIFWFRSHTAAEIRWGGAKHDSS-----DMDDSRRMH |
| atphya | DSVC--GMAAVRIS------SKDMIFWFRSHTAGEVRWGGAKHDPD-----DRDDARRMH |
| cpphya | DEVC--GMAAVRIT------NNDMIFWFRSHTASEIRWGGAKHEHG-----QKDDARKMH |
| cupphya | --LC--GMASVRIS------EKDWLFWFRSHTASEVRWGGVKHEP--------DDGRKMH |
| gmphya | DVVC--GMASVRVT------AKDMVFWFRSHTAAEIRWGGAKHEAG-----EKDDSRRMH |
| lephya | DAVC--GMAAVRIS------DKDWLFWFRSHTAAEVRWGGAKHEPG-----EKDDGRKMH |
| lsphya | DTVC--GMAAVRIT------SKDIVFWFRSHTAAEIRWGGAKHEPG-----EQDDGRKMH |
| mgphya | DGVC--GMAAVKIT------SNDMLFWFKAQTAAEIQWGGAKHESG-----ERDDGRKMH |
| ntphya | DVVC--GMAAVRIS------DKGWLFWYRSHTAAEVRWGGAKHEPG-----EKDDGRKMH |
| omphya | NALC--GMAAVKIT------DEDWLFWFRSHTAAEIRWGGAKHELE-----AKDDGRKMH |
| osphya | DMIC--GMAVAKIN------SKDILFWFRSHTAAEIRWGGAKHDPS-----DKDDSRRMH |

-continued

| Name/ SEQ ID No | Sequence |
|---|---|
| pcphya | DVVC--GMAVVKIT------SHDMLFWFRSHAAGHIRWGGAKAEPD-----ENHDGRKMH |
| psphya | DTVC--GMAAVRIT------SKDIVFWFRSHTAAEIRWGGAKHEPG-----DQDDGRKMH |
| sbphya | DMIC--GMAVAKIT------SKDILFWFRSHTAAEIKWGGAKHDPS-----DKDDNRRMH |
| slphya1 | DSVC--GMAAVSIT------VNDMLFWFTSHTAAEIKWGGAKHEAG-----EKDDGSKMH |
| slphya3 | DTVC--GMAAVRIT------LNNMLFWFRSHTAAEVKWGGAKHETG-----EKDDGSKMH |
| slphya4 | DTVC--GMAAVRIT------PNDMLFWFRSHTAAEVKWGGAKHETG-----EKDDGSKMH |
| stphya | DAVC--GMAAVRIS------DKDWLFWYRSHTAAEVRWGGAKHEPG-----EKDDGRKMH |
| taphya | DTVC--GMAVAKIN------SSDILFWFRSPTAKEIRWGGAKNDPS-----DMDDSRRMH |
| zmphya1 | DMIC--GMAVAKIT------SKDILFWFRSHTAAEIKWGGAKHDPS-----DEDDSRRMH |
| atphyb | DAVC--GMAVAYIT------KRDFLFWFRSHTAKEIKWGGAKHHPE-----DKDDGQRMH |
| atphyd | DAVC--GMAVACIT------KRDFLFWFRSHTEKEIKWGGAKHHPE-----DKDDGQRMN |
| gmphyb | MQFV--GWQVAYIT------EKDFLFWFRSHTAKEIKWGGAKLILR-----TRMMGQRMH |
| lephb1 | DAVC--GMAVAYIT------SKDFLFWFRSHTAKEIKWGGAKHHPE-----DKDDGQRMH |
| lephb2 | AAVC--GMAVAYVT------SKYFLFWFRSHTASEIKWGGAKHHPE-----DKDDWQKMH |
| npphyB | DAVC--GMAVAYIT------SKDFLFWFRSHTAKEIKWGGAKHHPE-----DKDDGQRMH |
| ntphyb | DAVC--GMAVAYIT------SKDFLFWFRSHTAKEIKWGGAKHHPE-----DKDDGQRMH |
| osphyb | DAVS--GMAVAYIT------PSDYLFWFRSHTAKEIKWGGAKHHPE-----DKDDGQRMH |
| pbphyb1 | NAVC--GMAVAYIT------KRDFLFWFRSHTAKEIKWGGAKHHPE-----DKDDGQRMH |
| pbphyb2 | DAVC--GMAVAYIA------ERDFLFWFRSHTAKEVKWGGAKHHPE-----DKDDGQRMH |
| sbphyB | DAVC--GMAVAYIT------PSDYLFWFRSHTAKEIKWGGAKHHPE-----DKDDGQRMH |
| slphyb | DAVC--GMAVAFIT------RSDFLFWFRSHPAKEIKWGGAKHHPE-----DKDDVQRMN |
| stphyb1 | DAVC--GMAVAYIT------SKDFLFWFRSHTAKEIKWGGAKHHPE-----DKDDGQRMH |
| stphyb2 | DAVC--GMAVAYIT------SKDFLFWFRSHTAKEIKWGGAKHHPE-----DKDDGQRMH |
| zmphyb1 | EAVC--GMAVAYIT------PSDYLFWFRSHTAKEIKWGGAKHHPE-----DKDDGQRMH |
| zmphyb2 | DAVC--GMAVAYIT------PSDYLFWFRSHTAKEIKWGGAKHHPE-----DKDDGQRMH |
| atphyc | ESIC--GMAAVYIS------EKDFLFWFRSSTAKQIKWGGARHDPN------DRDGKRMH |
| osphyc | DVVC--GMAAIKIS------SKDFIFWFRSHTAKEIKWGGAKHEPID----ADDNGRKMH |
| sbphyc | EVVC--GMAAIKIS------SKDFIFWFRSHTTKEIKWGGAKHEPVD----ADDNGRKMH |
| slphyc | DAVC--GMAAVRIS------SEEMLFWFRSHTAKEIKWGGAKHEPG-----QNDERGIMH |
| taphyc | EVVC--GMAAIKIS------SKGFIFWFRSHTAKEIKWGGAKHEPGD----ADDNGRRMH |
| zmphyc1 | EVVC--GMAAIKIS------SKDFIFWFRSHTTKEIKWGGAKHEPVD----ADDDGRRMH |
| zmphyc2 | EVVC--GMVAIKIS------SKNFIFWFRSHTTKEIKWSGAKHEPFD----ADDNGRKMH |
| lephye | DAVC--GMATARIT------SKDFLFWFRSHTAKEVKWGGAKHHPD-----DKDDGGKMH |
| atphye | DAVC--GVAAAEFS------SKDYLLWFRSNTASAIKWGGAKHHPK-----DKDDAGRMH |
| inphye | DAVS--GMATARIT------SKDFLFWFRSHTAKEVKWGGAKHHPE-----DKDDGGRMH |
| lephyf | DAVC--GMAAVKIT------SKDFLFWFRSHTAKEIKWGGAKHLPG-----DKDDGRKMH |
| acvphy1 | DAVC--GLAAAKIT------ATDFLFWFRSHTAKEVRWGGARHDPE-----ERDDGRRMH |
| acvphy2 | DAVC--GMAAAKIT------TRDFLFWFRSHTAKEIKWGGAKHDPE-----DRDDGRKMH |

-continued

| Name/ SEQ ID No | Sequence |
|---|---|
| acvphy3 | DAVC--GMAAAMIT-----PNSDFLFWFRSHTAKEVYWGGAEHDPQS----RDDDSWMQL |
| apphy1 | DAVC--GMAVAKIT------PRDFLFWFRSHTAKEVKWGGAKHDPD-----DRDDGRKMH |
| cpphy2 | DAVC--GMAAAKIT------AKDFLFWFRSHTAKEVKWGGAKHDPA-----EKDDGRKMH |
| mcphy1 | VSVC--GMAAARIT------SKDFLFWFRSHAQKEVKWAGAKQEPGDRDREEGEEGGRMH |
| mpphy1 | DAVC--GMAAARIT------SKDFLFWFRSHTAKEIKWGGAKHDPD-----DKDDGRKMH |
| msphy1 | VDVC--GMAAARIT------ENDFLFWFRGHAQKEVKWAGAKDGGS------EEDGSRMH |
| paphy1 | DAVC--GIAAARIT------SKDFLFWFRSHTAKEIIWGGAKHDPN-----DKDDGRRMH |
| ppphy0 | DAVC--GMAAAKIT------AKDFLFWFRSHTAKEIKWGGAKHDPG-----ENHDGRKMH |
| ppphy1 | DAVC--GMAAAKIT------AKDFLFWFRSHTAKEIKWGGAKHDPG-----EKDDGRKMH |
| ppphy2 | DAVC--GMAAAKIT------SKDFLFWFRSHTAKEIKWGGAKHDPD-----EKDDGRKMH |
| ppphy3 | DAVC--GMAAAKIT------SKDFLFWFRSHTAKEIKWGGAKHDPG-----EKDDNRKMH |
| ppphy4 | DAVC--GMAAAKIT------PRDFLFWFRSHTAKEIKWGGAKHDPD-----EKDDGRKMH |
| psphy1 | DAVC--GMASARIT------SKDFLFWFRSHTAKEMKWGGAKHHPD-----DKDDARRMH |
| smphy1 | DEVC--GMAAAKIT------AKDFLFWFRSATAKEVKWGGAKHDPD-----DKDDGRKMH |
| aphA | NVAS--GLLAIPIS------QRNYVLWFRPEVIQTVNWGGDPNQPFEVN--KLDGNVRLC |
| cph1 | SVAS--GLLAIPIA------RHNFLLWFRPEVLQTVNWGGDPNHAYEAT--QEDGKIELH |
| cwCph1 | NVAS--GLLAIKIS------HRNYILWFRPEVIQTVNWGGDPSKAYEMQ--KIDGNLRLC |
| npCph1 | NVAS--GLLAIPIAK------RTYVLWFRPEVIQTVNWGGDPNKAFEVS--QSEGNVRLC |
| cwCph1a | LQEF-------------------------------------------------------- |
| npCph1a | DTAS--GLLLLRISK----VRRYYILWFRPEVIQTVHWAGNPQESIKA---EGDGSYTLS |
| toCphA | NVAS--GLLAIPIS------KRNYVLWFRPEVIQTVNWGGNPNEAFEVS--QTEGNLRLV |
| aphB | DVAS--GLIALSISR----SQKNYILWFRPEVVRTVDWGGNPHKPVEVI---ANGEIRLS |
| atBphP1 | SVAS--GIIAMRVSE----LHGSWLIWFRPEVIKTVRWGGDPHKT-------VQESGRIH |
| atBphP3 | SVAS--GIIAMRVSE----LHGSWLIWFRPEVIKTVRWGGDPHKT-------VQESGRIH |
| avAphB | EVAS--GLIALSISR----SQKNYVLWFRPEVVRTVDWGGNPHKPVEVI---ANGGIRLS |
| chBphP1 | ASGIA-GINYHALDK----TSNSCIMWYKPETITEVKWAGDPNKAI------EKDKNGLS |
| chBphP2 | SVAS--GLLAFPVIP----DKGEYILCFRAEILQRIDWGGNPNEAIRF----NEDMKTYH |
| drbphP | PSAA--GLLAISVGE----GWSECLVWLRPELRLEVAWGGATPD---------QAKDDLG |
| goBphP | ERSA--GLLAITLPF----RTPTCLIWSRVEIIQTIEWAGNPHKDT------TEGSDVLR |
| krBphP | QTAA--GALRVGIDG------TGWLLWLRPERPRLLDWSGDPHHAEITR--VEGLEVRIS |
| mmBphP2 | AQAS--GVIALRVRLAWLSGSSLRLFWFRREWPHLVQWAGDPTKP-------GGSGGVLT |
| paBphP | DCC---GVLAIRFHR----QESGWIFWFRHEEVHRIRWGGKPEKLLT----IGPSGPRLT |
| pfBphP | QVAS--GVLAMSLPK----PVDNGVLWFRPEVKENINWSGDPRKPLDLE--NSDAGLRLR |
| ppBphP1 | NDVS--GVLIIPMSQ----HPRDYLIFFRKEVVETLDWAGDPNKTYD----SGALGDRLT |
| ppBphP2 | NHAG--GVLAVAISQ----IHSHYLLWFRPEQIRTVNWAGQPTKQV-------GPQGNLD |
| ppkBphP2 | NHAG--GVLAVAISQ----IHSHYLLWFRPEQIRTVNWAGQPTKQV-------GPQGNLD |
| psBphP1 | TLAS--GVLAMSLPK----PVDNGVIWFRPEVKQSVQWSGDPNKPLNLD--ASDNTLRLQ |
| psBphP2 | ETAS--GVIAFTLPK----PVDNAVMWFRSQLASTMNWSGNPAHHVSTRA-AGSASHGLR |
| pssBphP1 | PVAS--GVLAMSLPK----PVDNGVIWFRPEVKETVQWSGDPKKPLNME--SSAGGMRLR |

-continued

| Name/ SEQ ID No | Sequence |
|---|---|
| pssBphP2 | DIAS--GVIAFTLPK----PIDNAVMWFRAQLTSTMNWSGNPTHHVSTRP-ESSASHRLH |
| pstBphP1 | TLAS--GVLAMSLPK----PVDNGVIWFRPEVKQSVQWSGDPNKPLNLD--ASDNTLRLQ |
| rcPpr | QKAS--GCLALRLS------GGDFVMWTRPEEPRQITWGGDPAKAL------GAAGQRPM |
| rlBphP | --DAVAGMLAIPISR----SPRDYVVLFRQELVRTVRWGGDPHKPVEY----GPNGPRLT |
| atBphP2 | GTAA--GMLAIPLSQ----VKSDYLLFFRKEIVQNLNWAGNPEKSYET----GPMGDRLT |
| brBphP | SIAS--GLIAAPLSA----SEGEYLLWFRPEQVRTVTWGGDPLKAVII----GDDPSDLS |
| rpBphP1N | RMAS--GVVAAPISD----HRGEFLMWFRPERVHTVTWGGDPKKPFTM----GDTPADLS |
| rpBphP2N | EVAS--GVLAVPLSRT---PPRRVMLWFRPEVAQTVYWAGNPDKSV------TAESGRLR |
| rpBphP3N | DIAS--GLLAVPLGR----ASTTLMLWFRPEVAQTVTWGGDPHKPVQI----GPRGRRLQ |
| rpBphP4N | GCAS--GLLALSLSN----TPHNYVLWFRPEVVRVVTWAGMPNKPV-----GVDAGAPRT |
| rpBphP5N | SQAS--GVLALRPLP----DQPMLIAWLRPEQIEDVQWAGDPRKPVEIS--DADGMQRLR |
| rpBphP6N | GAAA--GMLAIPLSQ----VAGDYLLFFRKEQVQTLNWAGDPNKTYDT----GPLGDRLT |
| rrBphP | ------GGVLLPLSDQ---PDRDFLLLGRPETLRSIEWAGRPEKQPEI---TPEGGLKIH |
| rsBphP1 | AAGS--GILLLPLTS----GDGDLIAWFRPEHVQTITWGGNPAEHGT----WNPATQRMR |
| rsBphP1a | AAGS--GILLLPLTS----GDGDLIAWFRPEHVQTITWGGNPAEHGT----WNPATQRMR |
| toCphB | DVAS--GLMALSISK----SQKSYLLWFRPEALQTVDWAGNPHKPVEL---ADDGSLRLS |
| xaBphP | PLAA--GFIFVPLMP----QSRSALLWTRREQVQQVKWAGNPQLAKL----QDIPNSRLS |
| xcBphP | PLAA--GFIFVPLMP----QSRSALLWTRREQIQQIKWAGNPQLAKL----EDIPNSRLS |
| anFPH1 | GFKDISGLLYVPLST----DGLDFIVFFRRGQLTEVKWGGNPNEA-------KFTEGHLE |
| bfFPH2 | AINSVAGILVIPLST----GGNDFLVFFRRGQLREVRWAGNPYEKI-----KPAKGQYLE |
| chFPH1 | GFHAIAGMLIVPLSV----DGEDFIVFFRKGQLRQVKWAGNPYEKFI----KEGTEGYLE |
| cnFPH1 | ASDTIAGLLYVPLTAK---AGQDFIVFLRKGQVREVQWAGKPYKDD-----KASEEASLE |
| gmFPH1 | GFQVVAGLLYVPLSV----GGNDFIVFFRKGQIKEVKWAGNPYEKFV----REGTAGYLE |
| gzFPH1 | GFQVVAGLLYVPLSV----GGSDFIVFFRKGQIKEVKWAGNPYEKFV----REGTAGYLE |
| ncFPH1 | GFQVIAGLLYVPLSV----GGNDFIVLFRKGQVREVKWAGNPHEKTI----QAGSAAYLE |
| ncFPH2 | GFKAIAGVLYIPLSS----TTDDCVVFYRKNQIREVHWAGRPSL--------AGKIGRLE |
| umFPH1 | GLHVIAGLLVVPLSG----SGVDFIAFLRKAQLRHVNWAGKPFKE------GKEGEAILE |
| aphC | QPTKIRGILIIPLEYR--QQLLGYLSIFRNEIDTETLWAGR----------IDQDQRQMF |
| cph2 | SAENFQSFLIVPLAAD--QQWVGSLILLRKEKSLVKHWAGK----------RGIDRRNIL |
| npCph2a1 | QPTKIRGILTIPLQYR--QQLLGYLSIFRNEVDTETLWAGQ----------YDSDQRQLY |
| npCph2a2 | QTTQVRGLLIVPLQHG--STIVGCLTIFRDEVDIETIWAGC----------VDTDSRQLM |
| npCph2b | RSTQIRGLMVIPLHYR--EQFIGVLSIFRAEFETEILWAGR----------CEQNRRQLL |
| arphyA | PRSSFKAFLEVVKTRSLPWKDYEMDAIHSLQLILRNAFKDGEST------------DVN |
| asphya3 | PRLSFKAFLEVVKMKSLPWSDYEMDAIHSLQLILRGTLNDASK-------------PKR |
| asphya4 | PRLSFKAFLEVVKMKSLPWTDYEMDAIHSLQLILRGTLNDASK-------------PKR |
| atphya | PRSSFKAFLEVVKTRSLPWKDYEMDAIHSLQLILRNAFKDSETT------------DVN |
| cpphya | PRSSFKAFLEVVKTRSLPWKDYEMDAIHSLQLILRNTFKDTDAT------------EIN |
| cupphya | PRSSFKAFLEVVETRSLPWKDYEMDGIHSLQLIMRNAFFNEAD-------------TVA |

-continued

| Name/ SEQ ID No | Sequence |
|---|---|
| gmphya | PRSSFKAFLEVVKARSLPWKEYEMDAIHSLQIILRNAFKEDTESL------------DLN |
| lephya | PRSSFKAFLEVVKTRSIPWKDYEMDAIHSLQLILRNAFKDAEVV-------------NSN |
| lsphya | PRSSFKAFLEVVKARSVPWKDFEMDAIHSLQLILRNASKDTDII-------------DLN |
| mgphya | PRSSFKAFLEVVKTRSLPWKDYEMDAIHSLQLILRNAFKDTKAM-------------DAT |
| ntphya | PRSSFKAFLEVVKTRSVPWKDYEMDAIHSLQLILRNASKDADAM-------------DSN |
| omphya | PRSSFRAFLEVVKTRSLPWKDYEMDGIHSLQLILRNAYKESEE--------------KDLE |
| osphya | PRLSFKAFLEVVKMKSLPWNDYEMDAIHSLQLILRGTLNDDI--------------KPTR |
| pcphya | PRSSFKAFLEVVKTRSTTWKEFEMDAIHSLQLILRKALSVEKAVAAQG------DEIRSN |
| psphya | PRSSFKAFLEVVKARSVPWKDFEMDAIHSLQLILRNASKDTDII-------------DLN |
| sbphya | PRLSFKAFLEVVKMKSLPWSDYEMDAIHSLQLILRGTLNDAL--------------KPVQ |
| slphya1 | PRSSFKAFLEVVKRRSVPWKDYEMDAIHSLQLILRNAFKDGEAA-------------DLN |
| slphya3 | PRTSFKAFLEVVKRRSVPWKDYEMDAIHSLQLILRNAFKDVEAS-------------DLN |
| slphya4 | PRTSFKAFLEVVKRRSVPWKDYEMDAIHSLQLILRNAFKDVEAS-------------DLN |
| stphya | PRSSFKGFLEVVKTRSIPWKDYEMDRIHSLQLILRNAFKDADAV-------------NSN |
| taphya | PRLSFKAFLEVVKMKSLAWTDSEMDAIHSLQLILRGAVDGVVK--------------PTG |
| zmphya1 | PRLSFKAFLEVVKMKSLPWSDYEMDAIHSLQLILRGTLNDAL--------------KPAQ |
| atphyb | PRSSFQAFLEVVKSRSQPWETAEMDAIHSLQLILRDSFKESEAAM----------NSKVV |
| atphyd | PRSSFQTFLEVVKSRCQPWETAEMDAIHSLQLILRDSFKESEAMD----------SKAAA |
| gmphyb | PLSSFKAFLEVVKSRSLPWENAEMDAIHSLQLILRDSFKDAEH-------------RNS |
| lephb1 | PRSSFKAFLEVVKSRSSPWENAEMDAIHSLQLILRDSFKDAEA--------------SNS |
| lephb2 | PRSSFKAFLEVVKNRSLPWENAEMDAIHSLQLILRDSFKDAS----------------NS |
| npphyB | PRSSFKAFLEVVKSRSLPWENAEMDAIHSLQLILRDSFKDAEA--------------SNS |
| ntphyb | PRSSFKAFLEVVKSRSLPWENAEMDAIHSL-LILRDSFKDAE--------------ASNS |
| osphyb | PRSSFKAFLEVVKSRSLPWENAEMDAIHSLQLILRDSFRDSAEGT----------SNSKA |
| pbphyb1 | PRSSFKAFLEVVKSRSLLWENAEMDAIHSLQLILRDSFRDVEA--------------TNS |
| pbphyb2 | PRSSFKAFLEVVKSRSLPWENAEMDAIHSLQLILRDSFRDAEA--------------TNS |
| sbphyB | PRSSFKAFLEVVKSRSLPWENAEMDAIHSLQLILRDSFRDAAEGT----------SNSKA |
| slphyb | PRSSFKAFLEVVKSRSLPWENAEMDAIHSLQLILRDSFKDEET-------------THS |
| stphyb1 | PRSSFKAFLEVVKSRSSPWENAEMDAIHSLQLILRDSFKDAEA--------------SNS |
| stphyb2 | PRSSFKAFLEVVKSRSSPWENAEMDAIHSLQLILRDSFKDAEA--------------SNS |
| zmphyb1 | PRSSFKAFLEVVKSRSLPWENAEMDAIHSLQLILRDSFRDAAEGT----------NNSKA |
| zmphyb2 | PRSSFKAFLEVVKSRSLSWENAEMDAIHSLQLILRDSFRDAAEGT----------SNSKA |
| atphyc | PRSSFKAFMEIVRWKSVPWDDMEMDAINSLQLIIKGSLQEEH---------------SK |
| osphyc | PRSSFKAFLEVVKWRSVPWEDVEMDAIHSLQLILRGSLQDEDANK----------NNNAK |
| sbphyc | PRSSFKAFLEVVKWRSVPWEDVEMDAIHSLQLILRGSLQDEDAN-----------RNNVR |
| slphyc | PRSSFNAFLDVVKWRSVPWEDMEMDSIYSLQLIFIKCLVKNKTM----------SDTSK |
| taphyc | PRSSFRAFLEVVKWRSVPWEDVEMDAIHSLQLILRGSLQDEDAN-----------DNNAR |
| zmphyc1 | PRSSFKAFLEVVKWRSVPWEDVEMDAIHSLQLILRGSLPDEDAN-----------RNNVR |
| zmphyc2 | PRSSFKAFLEVVKWRSVPWEDVEMDAIHSLQLILRDSLQGEDAN-----------RNNIR |

-continued

| Name/ SEQ ID No | Sequence |
|---|---|
| lephye | PRSSFNAFLEVVKSRSLPWEIPEINAIHSLQIIMRESIQENEN--------------SSL |
| atphye | PRSSFTAFLEVAKSRSLPWEISEIDAIHSLRLIMRESFTSSR------------------ |
| inphye | PRSSFIAFLEVVKSRSLPWEDSEINAIHSLQLIMRDSLQGIGE--------------NYM |
| lephyf | PRSSFKAFLEVVKRRSLPWEDVEMDAIHSLQLILRGSLQDEA---------------ADC |
| acvphy1 | PRSSFKAFLEVVKQQSLFWEDVEMDAIHSLQLILRGSFQDIDD--------------SNT |
| acvphy2 | PRSSFKAFLEVVKRRSLPWEDMEMDAIHSLQLILRGSFQDIDD--------------SDT |
| acvphy3 | PRSSFKAFLEIVKRRSLPWEEVEVDAIRSLQLILREDLEQFCAAVGAVKASDGDDEDSLV |
| apphy1 | PRSSFKAFLEVVKRRSSPWEDVEMDAIHSLQLILRGSFQDIDD--------------SDT |
| cpphy2 | PRSSFKAFLEVVKRRSLPWEDVEMDAIHSLQLILRGSFQDIDD--------------SDT |
| mcphy1 | PRSSFQAFLEVVKQRSLPWEDVEMDAIHSLQLILRGSFQDMEGEGGG--------SQQGN |
| mpphy1 | PRSSFKAFLEVVKRRSLPWEDVEMDAIHSLQLILRGSFQDIDD--------------SDT |
| msphy1 | PRSSFKAFLEVVKQRSLPWEDVEMDAIHSLQLILRGSFQDIED--------------KED |
| paphy1 | PRSSFKAFLEVVKRRSLPWEDVEMDAIHSLQLILRDSFHDIDD--------------SDS |
| ppphy0 | PRSSFKAFLEVVKRRSLPWEDVEMDAIHSLQLILRGSFQDIAD--------------SDT |
| ppphy1 | PRSSFKAFLEVVKRRSLPWEDVEMDAIHSLQLILRGSFQDIDD--------------SDT |
| ppphy2 | PRSSFKAFLVVVKRRSLPWEDIEMDAIHSLQLILRGSFQDIDD--------------SDT |
| ppphy3 | PRSPFKAFLEVVKRRSLPWEDVEMDAIHSLQLILRGSFQDIDD--------------SDT |
| ppphy4 | PRSSFKAFLEVVKRRSLPWEDIEMDAIHSLQLISRGSFQDIDD--------------SDT |
| psphy1 | PRSSFKAFLEVVKRRSLPWDNVEIDAIHSLQLILRCSFRDIDD--------------SGT |
| smphy1 | PRSSFKAFLEVVKRRSLPWEDVEMDAIHSLQLILRGSFQDIDD--------------SDT |
| aphA | PRKSFELWKETVRLTSLPWRYVEIRAALELRKAIVNI----------------------- |
| cph1 | PRQSFDLWKEIVRLQSLPWQSVEIQSALALKKAIVNL----------------------- |
| cwCph1 | PRKSFELWKETVRLTSLSWKPIEIKAALGLKEAIVNI----------------------- |
| npCph1 | PRKSFELWKETVRLTSLPWKDVEVKAALELRKAIVNI----------------------- |
| cwCph1a | ------------------------------------------------------------ |
| npCph1a | PRKSFEQWQETVRLTSLPWKGCELESAIALSNAIVGI----------------------- |
| toCphA | PRKSFELWKENVQLTSLRWKAVEIKAALELRKAIINI----------------------- |
| aphB | PRKSFDLWKETVLLKSQPWKSHEVNAALELRSAIIGI----------------------- |
| atBphP1 | PRKSFEIWKEQLRNTSFPWSEPELAAARELRGAIIGI----------------------- |
| atBphP3 | PRKSFEIWKEQLRNTSFPWSEPELAAARELRGAIIGI----------------------- |
| avAphB | PRKSFELWKETVLLKSHPWKSYEVNAALELRSAIIGI----------------------- |
| chBphP1 | PRKSFELWGEKVKNQSIPWSQPDLIASSNFANFLQKHLGYIF------------------ |
| chBphP2 | PRHSFEIWKEEIKSTSQPFQEYEMNFAKELQRIFIET----------------------- |
| drbphp | PRHSFDTYLEEKRGYAEPWHPGEIEEAQDLRDTLTGA----------------------- |
| goBphP | PRASFRTWEQTIRGHSTRWTSEQKQAARRLRRVLIADYQTQQLRELNAT----------- |
| krBphP | PRKSFEKWSEVVRGRSTTWRSWHAATADRLRTQVTGIMLGRSRGQ--------------- |
| mmBphP2 | PRQSFTTWSELARGRARPWELPDLLAAKTLRACLCSLKVPAA------------------ |
| paBphP | PRGSFEAWEEVVRGHSTPWSETDLAIAEKLRLDLMEL----------------------- |

-continued

| Name/ SEQ ID No | Sequence |
|---|---|
| pfBphP | PRTSFEIWKVEMAGISTKWSHGDLFAANDLRRSALEN---------------------- |
| ppBphP1 | PRKSFAIWKETVHQQSLPWTEQDRQFGDAIRTAIVEV---------------------- |
| ppBphP2 | PRHSFERWQEEQRGYSQAWDPLVIEGVIELRAAVLGI---------------------- |
| ppkBphP2 | PRHSFERWQEEQRGYSQAWDPLVIEGVIELRAAVLGI---------------------- |
| psBphP1 | PRTSFEIWKVEMTGIATKWSHGDVFAANDLRRSALEN---------------------- |
| psBphP2 | PRQSFDVWKQEVTGIARPWSRADLYGAEDIRRSALES---------------------- |
| pssBphP1 | PRTSFEIWKVEMTGIATKWSYGDVFAANDLRRSALEN---------------------- |
| pssBphP2 | PRQSFDVWEQEVTGIASPWSRADLYGAEDIRRSALES---------------------- |
| pstBphP1 | PRTSFEIWKVEMTGIATKWSHGDVFAANDLRRSALEN---------------------- |
| rcPpr | PRISFDRWVEERRGHAAPWPTWADEIATSLRHAISDM---------------------- |
| rlBphP | PRKSFEAWSELVRGRSLPFTEAERRVAETIRVTLIEV---------------------- |
| atBphP2 | PRKSFAIWKETVRLQAQPWSEADREIAEAARIALVEV---------------------- |
| brBphP | PRRSFAQWHQLVEGKSEPWSPAELASARLVSETVADV---------------------- |
| rpBphP1N | PRRSFAKWHQVVEGTSDPWTAADLAAARTIGQTVADI---------------------- |
| rpBphP2N | PRTSFAAWTEQTHGRAIAWQPHEVAAAVEIRDLIIDV---------------------- |
| rpBphP3N | TRASFEAWREEVRDRSRPWRSHEIVAAEEIRDLVVDV---------------------- |
| rpBphP4N | PKGCASSWQESVRLHGEPWLDTDVDAAHRLRESLLDVVLRRI----------------- |
| rpBphP5N | PRNSFALWKESVQGRAVPWRDDEKDAATRLAAAIAEI---------------------- |
| rpBphP6N | PRKSFSIWKEQVDGQSVPWSPDDRDTAATIQVGLREV---------------------- |
| rrBphP | PRTSFSLWREEVRGRSVAFDPLDRETAETLSLFLAERLAKQRRQ--------------- |
| rsBphP1 | PRASFDAWKETVTGRSLPWTSAERNCARELGEAIAAEMAQRT----------------- |
| rsBphP1a | PRASFDAWKETVTGRSLPWTSAERNCARELGEAIAAEMAQRT----------------- |
| toCphB | PRKSFDLWKEIVQRQSLPWESYEIEAVWNFRSAIVGV---------------------- |
| xaBphP | PRKSFDLWQQTVRGRARRWSPLHLESARSLRVLIELMERKRFQQ----------DFTLL |
| xcBphP | PRKSFDLWQQTVRGRARRWSPLHLESARSLRVLIELMERKRFQQ----------DFTLL |
| anFPH1 | PRKSFQTWRETVLDRCRDWTESEVDTAAVLCLVYGKF---------------------- |
| bfFPH2 | PRSSFSRWTQTIKGTSKIWNADDFETASVLSLLYGRF---------------------- |
| chFPH1 | PRKSFKTWSETVVGKCLEWTEEEIETASVLCLVYGKF---------------------- |
| cnFPH1 | PRKSFKAWTETVTGCSRAWTDHQLESAGVLALIYGKF---------------------- |
| gmFPH1 | PRKSFKTWNETVVGKCREWNEEQVETAAVLCLVYGKF---------------------- |
| gzFPH1 | PRKSFKTWHETVVGKCREWNEEQVETAAVLCLVYGKF---------------------- |
| ncFPH1 | PRKSFKVWYETVIGKSREWSEEEVETAAVLCLVYGKF---------------------- |
| ncFPH2 | PRNSFKKWTEVVDGTSKAWSIEHTNLAAMAQLLYGSF---------------------- |
| umFPH1 | PRKSFKVWSETVEGTCRAWKDEELETASVLCLVYGKF---------------------- |
| aphC | PRVSFNLWRDAKKSQAQEWTSEEIELAKEIGQHFASAIQQYE----------------L |
| cph2 | PRLSFEAWEETQKLV-PTWNRSERKLAQVASTQLYMAITQQF----------------- |
| npCph2a1 | PRRSFEVWRESKKAQAQKWTVEEIELARDIGKHFASAIQQYE----------------L |
| npCph2a2 | PRQSFAAWRELRTGQAQQWSESEIKLAQALGERFATAVKQHR----------------L |
| npCph2b | PQLSFEIWREQKKGLAPEWKPEDMTLAQALYDHFSMAIQQQQ----------------I |

-continued

| Name/ SEQ ID No | Sequence |
|---|---|
| arphyA | TKFIHSKLNDLKIDG---------------------------IQELEAVTSEMVRLIETA |
| asphya3 | EASLDNQIGDLKLDG---------------------------LAELQAVTSEMVRLMETA |
| asphya4 | EASLDNQIGDLKLDG---------------------------LAELQAVTSEMVRLMETA |
| atphya | TKVIYSKLNDLKIDG---------------------------IQELEAVTSEMVRLIETA |
| cpphya | RKSIQTTLGDLKIEG---------------------------RQELESVTSEMVRLIETA |
| cupphya | TNVIHAKLNDLRIDG---------------------------LQELEAVTSEMVRLIETA |
| gmphya | AKAINTRLRDLKIEGINDLKIER-------------------MQELEAVTSEIVRLDYTA |
| lephya | TNSIYKKLNDLKIDG---------------------------MQELESVTAEMVRLIETA |
| lsphya | TKAINTRLNDLKIEG---------------------------MQELEAVTSEMVRLIETA |
| mgphya | TDVIHTRLHDLKIEG---------------------------MEELEAVTSEMVRLIETA |
| ntphya | TNIIHTKLNDLKIDG---------------------------LQELEAVTAEMVRLIETA |
| omphya | SREIHARLNELQIDG---------------------------VKEIEAVTSEMVRLIETA |
| osphya | AASLDNQVGDLKLDG---------------------------LAELQAVTSEMVRLMETA |
| pcphya | TDVIHTKLNDLKIEG---------------------------IQELEAVTSEMVRLIETA |
| psphya | TKAINTRLNDLKIEG---------------------------MQELEAVTSEMVRLIETA |
| sbphya | ASGLDNQIGDLKLDG---------------------------LAELQAVTSEMVRLMETA |
| slphya1 | TSVIHSKISDLQISG---------------------------LKELEAVTSEMVRLIETA |
| slphya3 | TSVIHSKISDLQING---------------------------LRELEAVTSEMVRLIETA |
| slphya4 | TSVIHSKISDLQING---------------------------LRELEAVTSEMVRLIETA |
| stphya | TISIHTKLNDLKIDG---------------------------MQELEAVTAEMVRLIETA |
| taphya | KASLDEQIGDLKLDG---------------------------LAELQAVTSEMVRLMETA |
| zmphya1 | SSGLDNQIGDLKLDG---------------------------LAELQAVTSEMVRLMETA |
| atphyb | DGVVQPCRDMAGEQG---------------------------IDELGAVAREMVRLIETA |
| atphyd | AGAVQPHGDDMVQQG---------------------------MQEIGAVAREMVRLIETA |
| gmphyb | KAVVDPHVSEQELQG---------------------------VDELSSVAREMVRLIETA |
| lephb1 | KAIVHA-LGEMELQG---------------------------IDELSSVAREMVRLIETA |
| lephb2 | KSIVRVQLREEGLQG---------------------------MDELRSVAREMVRLVETA |
| npphyB | MAVVHAQLGEMELQG---------------------------IDELSSVAREMVRLIETA |
| ntphyb | KAVVHAQLGEMELQG---------------------------IDELSSVAREMVRLIETA |
| osphyb | IVNGQVQLGELELRG---------------------------IDELSSVAREMVRLIETA |
| pbphyb1 | KAVVHAQLEDTELQG---------------------------MDELSSVAREMVRLIETA |
| pbphyb2 | KAVVHTQLKDMELQG---------------------------MDELSSVAREMVRLIETA |
| sbphyB | IVNGQVQLGELELRG---------------------------INELSSVAREMVRLIETA |
| slphyb | KAIVHDQAGDVAMQG---------------------------IDELSSVAKEMVRLIETA |
| stphyb1 | KAIVHAHLGEMELQG---------------------------IDELSSVAREMVRLIETA |
| stphyb2 | KAIVHAHLGEMELQG---------------------------IDELSSVAREMVRLIETA |
| zmphyb1 | IVNGQVQLRELELRG---------------------------INELSSVAREMVRLIETA |
| zmphyb2 | IVNGQRQLGELELRG---------------------------INELSSVAREMVRLIETA |

-continued

| Name/ SEQ ID No | Sequence |
|---|---|
| atphyc | TVVDVP-LVDNRVQK---------------------------VDELCVIVNEMVRLIDTA |
| osphyc | SIVTAPSDDMKKIQG---------------------------LLELRTVTNEMVRLIETA |
| sbphyc | SIVKAPPDDTKKIQG---------------------------LLELRTVTNEMVRLIETA |
| slphyc | MIVNVPGVGVGGPLSS--------------------------ALKVEPLTGEVIRLIETA |
| taphyc | SIVEAPSDDIKKIQG---------------------------LLELKIVTNEMVRLIETA |
| zmphyc1 | SIVKAPSDDMKKIQG---------------------------LLELRTVTNEMVRLIETA |
| zmphyc2 | SIVKAPSDDMKKLQG---------------------------LLELRTVTNEMVRLIETA |
| lephye | KTLTTSQQNDADGPS---------------------------MDELSSVAMEMVRLIETA |
| atphye | -PVLSGNGVARDAN------------------------------ELTSFVCEMVRVIETA |
| inphye | KSVSSPQQNDSDGVR---------------------------FYELSSMALELVRLVETA |
| lephyf | SKMIVNVPAVDTIID---------------------------RVDTLHIN-DMVRLVETA |
| acvphy1 | KTMIHARLNDLKLQG---------------------------LDELSTVASEMVRLIETA |
| acvphy2 | KTMIHARLNDLKLHG---------------------------MDELSTVANEMVRLIETA |
| acvphy3 | PSAKKLSLKETEENGGADNSKKLERMHSAAAGGGGGGGRWEKMRLPSSLAQEWMEAIRGT |
| apphy1 | KTMIHARLNDLKLQG---------------------------MDELSTVANEMVRLIETA |
| cpphy2 | KTMIHARLNDLKLHG---------------------------MDELSVVANEMVRLIETA |
| mcphy1 | KRMINARLNDLKLQG---------------------------MDELSTVANEMVRLIETA |
| mpphy1 | KTMIHARLNDLKLQG---------------------------MDELSTVANEMVRLIETA |
| msphy1 | RKIVHARLKEMHLQG---------------------------MEELSSVASEMVRLIETA |
| paphy1 | KTMIHARLNDLRLQG---------------------------IDELSAVTNEMVRLIETA |
| ppphy0 | KTMIHARLNDLKLHD---------------------------MDELSVVANEMVRLIETA |
| ppphy1 | KTMIHARLNDLKLHD---------------------------MDELSVVANEMVRLIETA |
| ppphy2 | KTMIHARLNDLKLQD---------------------------MDELSTVANEMVRLIETA |
| ppphy3 | KTMIHARLNDLKLHD---------------------------MDELSIVANEMVRLIETA |
| ppphy4 | KTMIHARLNDLKLQG---------------------------MDELSTVANEMVRLIETA |
| psphy1 | KTMVHSRLNYLRLQG---------------------------IDELSSVASEMVRLIETA |
| smphy1 | KTMIHARLNDLKLQG---------------------------MDELSTVANEMVRLIETA |
| aphA | ---VLRQADELAQLAHDLERSNAEL----------------------------------- |
| cph1 | ---ILRQAEELAQLARNLERSNADL----------------------------------- |
| cwCph1 | ---ILRQADELAELAHDLELSNAEL----------------------------------- |
| npCph1 | ---VLRQADELAQLAQDLERSNAEL----------------------------------- |
| cwCph1a | ------------------------------------------------------------ |
| npCph1a | ---VLSKADELAKINLELERSNQEL----------------------------------- |
| toCphA | ---VLRQADELAQLAHDLERSNAEL----------------------------------- |
| aphB | ---VLQKADELAQLNIELERSNQEL----------------------------------- |
| atBphP1 | ---VLRKTEEMADLTRELQRTNKEL----------------------------------- |
| atBphP3 | ---VLRKTEEMADLTRELQRTNKEL----------------------------------- |
| avAphB | ---VLQKADELAQLNIELKRSNQEL----------------------------------- |
| chBphP1 | ---LAEEEEKQRQMTEILKEVNSEL----------------------------------- |

-continued

| Name/<br>SEQ ID No | Sequence |
|---|---|
| chBphP2 | ---RLKEQNRR------------------------------------------------- |
| drbphp | ---LGERLSVIRDLNRALTQSNAEW----------------------------------- |
| goBphP | ---LAATLEERESLLRQK------------------------------------------ |
| krBphP | -IAIAESLQRAVVLDEAPHVPGVEV-----------------LARYRPAEGSQLGGDWWD |
| mmBphP2 | ------------------------------------------------------------ |
| paBphP | ---CLNHAAEVDRMR--------------------------------------------- |
| pfBphP | ---DLARQVRREQEAVRAR----------------------------------------- |
| ppBphP1 | ---VLHNSELLASERAKADVRQ-------------------------------------- |
| ppBphP2 | ---VLRKAEELAQLAGELRRSNKEL----------------------------------- |
| ppkBphP2 | ---VLRKAEELAQLAGELRRSNKEL----------------------------------- |
| psBphP1 | ---DLARQVSKEQQAVRAR----------------------------------------- |
| psBphP2 | ---DLERQVQREQEAVRLR----------------------------------------- |
| pssBphP1 | ---DLARQVRREQQAVRAR----------------------------------------- |
| pssBphP2 | ---DLERQVQREQEAVRLR----------------------------------------- |
| pstBphP1 | ---DLARQVSKEQQAVRAR----------------------------------------- |
| rcPpr | ---MLRHLRHVKELSDQLAASNEAK----------------------------------- |
| rlBphP | ---VLRLTDEVSMARQTANERQ-------------------------------------- |
| atBphP2 | ---AFHHSELMAGERERAEVRQ-------------------------------------- |
| brBphP | ---ALQLRSVR--------------------------------MVIAQDQLATISAQVLR |
| rpBphP1N | ---VLQFRAVR--------------------------------TLIAREQYEQFSSQVHA |
| rpBphP2N | ---ILRNTEKLERINTQLARSNEEL----------------------------------- |
| rpBphP3N | ---ILGRAEELENANRELSRSNDEL----------------------------------- |
| rpBphP4N | -DGIARERRSAQLLQEQLMRQV-------------------------------------- |
| rpBphP5N | ---AAARKGRIERINRALDASHSEL----------------------------------- |
| rpBphP6N | ---LLRQSEILSAERKKAEVRQ-------------------------------------- |
| rrBphP | QAVVALEETRQRLRDLAECSS---------------------------------DWLWET |
| rsBphP1 | RAELARLRHYDPLTGLANRSYLQERLAQDGQSAAALLFIDLDRFKAVNDSMGHGVGDGLL |
| rsBphP1a | RAELARLRHYDPLTGLANRSYLQERLAQDGQSAAALLFIDLDRFKAVNDSMGHGVGDGLL |
| toCphB | --VLRKADELAKMNVELQRSNDEL------------------------------------ |
| xaBphP | EASLSRLRDGVAIIE--------------------------------------RGAKGAA |
| xcBphP | EASLSRLRDGVAIIE--------------------------------------RGTANAA |
| anFPH1 | -IKVWRQQEAALESSSLT------------------------------------------ |
| bfFPH2 | -IEIWRQKESTGLNRMT------------------------------------------- |
| chFPH1 | -IEVWRQKEAALQSSQLT------------------------------------------ |
| cnFPH1 | -IQVWREKQTAMASNQLT------------------------------------------ |
| gmFPH1 | -IEVWRQKEMALQNSKLT------------------------------------------ |
| gzFPH1 | -IEVWRQKEKALQNSKLT------------------------------------------ |
| ncFPH1 | -IEVWRQKEAALRSSRLT------------------------------------------ |

-continued

| Name/ SEQ ID No | Sequence |
|---|---|
| ncFPH2 | -IQVWREKETAINDTRLK------------------------------------------ |
| umFPH1 | -ISVWRQREQALHYNQLN------------------------------------------ |
| aphC | YQQVQAFNENLEKQVQKRTLELRHTS--------------EQQQAVFGVISKIRESLDTN |
| cph2 | VTRLITQQTAYDPLTQLPNWIIFNRQLTLALLDALYEGKMVGVLVIAMDRFKRINESFGH |
| npCph2a1 | QQQVQVFNENLEKQVKRRTVELQRTA--------------EQEQAVFKVIAEIRESLDTD |
| npCph2a2 | YEQVQALNANLEQQVRDRTLELQQTNTDLQHSTIELQRSVERQQALARIIANMRQSLDVT |
| npCph2b | YKEVQALNANLELRVQEQTAELEKSL--------------LLTKVIKQITEQIRRTLDLQ |
| arphyA | TVPILAVDSDGLVNGWN--------------------------TKIAELTGLPVDEAIG- |
| asphya3 | TVPILAVDGNGLVNGWN--------------------------QKAAELTGLRVDDAIG- |
| asphya4 | TVPILAVDGNGLVNGWN--------------------------QKAAELTGLRVDDAIG- |
| atphya | TVPILAVDSDGLVNGWN--------------------------TKIAELTGLSVDEAIG- |
| cpphya | TVPILAVDLDGLINGWN--------------------------TKIAELTGLPVDKAIG- |
| cupphya | MVPIIAVGVDGLVNGWN--------------------------TKIAELTGLSVDEAIG- |
| gmphya | TVPILAVDVDGLVNGWN--------------------------IKIAELTGLPIGEATG- |
| lephya | LVPILAVDVDGQVNGWN--------------------------TKIAELTGLPVDEAIG- |
| lsphya | TVPILAVDVDGTVNGWN--------------------------IKIAELTGLPVGEAIG- |
| mgphya | TVPILAVDVDGLVNGWN--------------------------LKIAELTGLPVDKAIG- |
| ntphya | SVPIFAVDVDGQLNGWN--------------------------TKIAELTGLPVDEAIG- |
| omphya | TVPIFSVGVDGLVNGWN--------------------------TKISDLTGLSVVEAIG- |
| osphya | TVPILAVDSNGLVNGWN--------------------------QKVAELTGLRVDEAIG- |
| pcphya | TVPIFAVDADEIVNGWN--------------------------TKIAELTGLPVDQAMG- |
| psphya | TVPILAVDVDGTVNGWN--------------------------IKIAELTGLPVGEAIG- |
| sbphya | TVPILAVDGNGLVNGWN--------------------------QKVAELSGLRVDEAIG- |
| slphya1 | TVPIFAVDSDGLVNGWN--------------------------TKIYELTGIPVEEAVG- |
| slphya3 | TVPILAVDADGLVNGWN--------------------------TKIFELTGVPVAEAVG- |
| slphya4 | TVPILAVDADGLVNGWN--------------------------TKISELTGVPVAEAVG- |
| stphya | SVPIFAVDVDGQVNGWN--------------------------TKVAELTGLPVDEAIG- |
| taphya | TVPILAVDGNGLVNGWN--------------------------QKAAELTGLRVDDAIG- |
| zmphya1 | TVPILAVDGNGLVNGWN--------------------------QKVADLSGLRVDEAIG- |
| atphyb | TVPIFAVDAGGCINGWN--------------------------AKIAELTGLSVEEAMGK |
| atphyd | TVPIFAVDIDGCINGWN--------------------------AKIAELTGLSVEDAMGK |
| gmphyb | TAPIFAVDVDGHVNGWN--------------------------AKVSELTGLPVEEAMGK |
| lephb1 | TAPIFGVDVNGRINGWN--------------------------EKVVELTGLSAEEAKGK |
| lephb2 | TAPIFAVDVEGRINAWN--------------------------AKVAELTELSVEEAIGK |
| npphyB | TAPIFAVDVDGRINGWN--------------------------AKVAELTDLSVEEAMGK |
| ntphyb | TAPIFAVDVEGRINGWN--------------------------AKVAELTDLSVEEAMGK |
| osphyb | TVPIFAVDTDGCINGWN--------------------------AKVAELTGLSVEEAMGK |
| pbphyb1 | TAPIFAVDVDGCINGWN--------------------------AKVAELTGLSVDKAMGK |
| pbphyb2 | TAPIFAVDVDGRINGWN--------------------------AKVAELTGLSVEEAMGK |

-continued

| Name/ SEQ ID No | Sequence |
| --- | --- |
| sbphyB | TVPIFAVDTDGCINGWN--------------------------AKIAELTGLSVEEAMGK |
| slphyb | MAPIFAVDADGCINGWN--------------------------AKASELIGLSVEEAMGK |
| stphyb1 | TAPIFAVDVEGRINGWN--------------------------AKVAELTGVSVEEAMGK |
| stphyb2 | TAPIFAVDVEGRINGWN--------------------------AKVAELTGVSVEEAMGK |
| zmphyb1 | TVPIFAVDTDGCINGWN--------------------------AKIAELTGLSVEEAMGK |
| zmphyb2 | TVPIFAVDTDGCINGWN--------------------------AKIAELTGLSVEEAMGK |
| atphyc | AVPIFAVDASGVINGWN--------------------------SKAAEVTGLAVEQAIG- |
| osphyc | TAPILAVDITGSINGWN--------------------------NKAAELTGLPVMEAIG- |
| sbphyc | TAPVLAVDIAGNINGWN--------------------------NKAAELTGLPVMEAIG- |
| slphyc | AVPIFSVDVTGAINGWN--------------------------FKVAELTGVPMEQVIG- |
| taphyc | TAPILAVDIVGNINGWN--------------------------NKVAEITGLPTTEAIG- |
| zmphyc1 | TAPVLAVDIAGNINGWN--------------------------NKAAELTGLPVMEAIG- |
| zmphyc2 | TAPVLAVDIAGNINGWN--------------------------KKAAELTGLPVMEAIG- |
| lephye | TAPIFGVDPSGLINGWN--------------------------EKIADLTGLHASEAVGM |
| atphye | TAPIFGVDSSGCINGWN--------------------------KKTAEMTGLLASEAMGK |
| inphye | TVPIFGVDSSGLINGWN--------------------------AKIAELTGLQANVAIGK |
| lephyf | SMPVLAVDTSGRINGWN--------------------------SKVSELTGLPVENVIG- |
| acvphy1 | TAPILAVDGQGLINGWN--------------------------GKVAELTGLCFETAMGK |
| acvphy2 | TAPIFAVDAGGFINGWN--------------------------AKVAELTGLTVEEAMSR |
| acvphy3 | GDGGASGGGGGGPFDWDLISAFQHNSFIVVDALKPDFPIIYASTGFFNLTGYTSREVIGG |
| apphy1 | TAPIFAVDASGCINGWN--------------------------AKVAELTGLPVEEAMNR |
| cpphy2 | TAPILAVDSTGMINGWN--------------------------AKIAHVTGLPVSEAMGR |
| mcphy1 | TAPILAVDSLGCVNGWN--------------------------AKVSELTGLPVSEAMGK |
| mpphy1 | TAPILAVDSSGFINGWN--------------------------AKVAELTGLPVSEAMGR |
| msphy1 | TAPILAVDTAGCVNGWN--------------------------FKISELTGLSIPEVMGK |
| paphy1 | TVPILAIDSNGLVNGWN--------------------------TKAAELTGLLADEVIGR |
| ppphy0 | TAPILAVDSNGMINGWN--------------------------AKIAQVTGLPVSEAHGR |
| ppphy1 | TAPILAVDSNGMINGWN--------------------------AKIAQVTGLPVSEAHGR |
| ppphy2 | TAPILAVDSGGFINGWN--------------------------AKVAELTGLPVEEAMGR |
| ppphy3 | TAPILAVDSNGMINGWN--------------------------AKIAQETGLPVAEAMGR |
| ppphy4 | TAPILAVDSSGFINGWN--------------------------AKVAELTGLPVGEAMGR |
| psphy1 | TAPILAVDYNGLVNGWN--------------------------AKVAELTGLPVGEAMGM |
| smphy1 | TAPILAVDSSGFINGWN--------------------------AKVADVTGLPVTEAMGR |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |

-continued

| Name/ SEQ ID No | Sequence |
|---|---|
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | VLPLEAGRVAIVVGDVA--------------------------GHGVHAAAAMAQLRTAL |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | SEQPVIIADVEGRILLLNE-------------------AFEQQLRASHPHIPHLRDLG-- |
| rpBphP1N | SMQPVLITDAEGRILLMND-------------------SFRDMLPAGSPSAVHLDDLA-- |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | TGDGTLALVSDRINGLGDLRPEELVGRKLVDLVGGGDSGGAPGVDADEIASAFDEGRAFH |
| rsBphP1 | IEVARSLVATVRPHDLVVRLGGDEFVVLCHRLDAAGIVSLAERLRQVLEQPFEVAGRKCH |
| rsBphP1a | IEVARSLVATVRPHDLVVRLGGDEFVVLCHRLDAAGIVSLAERLRQVLEQPFEVAGRKCH |
| toCphB | ------------------------------------------------------------ |
| xaBphP | HRLMFVNPAFAELSQTEVADLIGCDILALLDDDAARGKVELLEEALRLGRAAYVTLPLRT |
| xcBphP | HRLLFVNTAFADVCGSDVAELIGRELQTLYASDAPRANVELLQDALRNGRAAYVTLPLQV |
| anFPH1 | ------------------------------------------------------------ |

-continued

| Name/ SEQ ID No | Sequence |
|---|---|
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | TIFQITTKEACQLIKADR---------------------VSVYRFDNEWGGEFVGDFEAT |
| cph2 | KTGDGLLQEVADRLNQKLSPLAAYSPLLSRWHGDGFTILLTQISDNQEMIPLCERLLSTF |
| npCph2a1 | TIFQTTTKEVCQLIKADR---------------------VSVYRFDSNWGGEFVGDFEAA |
| npCph2a2 | TIFRTTTQEVCQLLECDR---------------------LSVYRFNADWGGEFVGDYETA |
| npCph2b | TTLQTIVSEVRSLLNSDR---------------------VVIFQLNSKS--VIVEEMNGN |
| arphyA | ---------------KHLLTLVEDSSVEIVKRMLENALEGTEEQNVQFEIKTHL--SRAD |
| asphya3 | ---------------RHILTLVEDSSVPVVQRMLYLALQGKEEKEVRFEVKTHG--PKRD |
| asphya4 | ---------------RHILTLVEESSVPVVQRMLYLALQGKEEKEVRFEVKTHG--PRRD |
| atphya | ---------------KHFLTLVEDSSVEIVKRMLENALEGTEEQNVQFEIKTHL--SRAD |
| cpphya | ---------------KHLLTLVEDSSVEVVRKMLFLALQGQEEQNVQFEIKTHG--SHIE |
| cupphya | ---------------NHLLTLVEDSSVHTVKKMLNLALQGEEEKNVQFEIMTHG--IRSE |
| gmphya | ---------------KHLLTLVEDSSTDRVKKMLNLALLGEEEKNVQFEIKTLG--SKMD |
| lephya | ---------------KHLLTLVEDSSVDTVNKMLELALQGKEEKNVEFEIKTHG--PSRD |
| lsphya | ---------------KHLLTLVEDSSTDIVKKMLNLALQGEEEKNVQFEIKTHG--DQVE |
| mgphya | ---------------RDLLSLVEDSSTGIVKKMLDLALQGKEEQNIQFELKTDE--SRRD |
| ntphya | ---------------NHLLTLVEDSSVDTVSKMLELALQGKEERNVEFEIKTHG--PSGD |
| omphya | ---------------MHFLALVEDSSADTVSKMLGLALQGKEEHDVQFEIKTHG--QRSE |
| osphya | ---------------RHILTVVEESSVPVVQRMLYLALQGKEEKEVKFEVKTHG--SKRD |
| pcphya | ---------------KHLLTLVEDSSVGTVVFLLALALQGKEEQGIPFEFKTYG--SRED |
| psphya | ---------------KHLLTLVEDSSTDIVKKMLNLALQGEEEKNVQFEIKTHG--DQVE |
| sbphya | ---------------RHILTLVEDSSVSIVQRMLYLALQGKEEKEVRFELKTHG--SKRD |
| slphya1 | ---------------KHIAALVEDSSIDNVKQMLQSALQGEEKKNVQFEVKRHH--SIPD |
| slphya3 | ---------------KHIASLAEESSIDNVKRMLQLALQGEEKKNVQFEIKRHQ--SNPD |
| slphya4 | ---------------KHIASLAEESSIDNVKRMLQLALQGEEKKNVQFEIKRHQ--SNPD |
| stphya | ---------------KHLLTLVEDSSVDTVNKMLELALQGQEERNVEFEIKTHG--PSRD |
| taphya | ---------------RHILTLVEESSVSVVQRMLYLALQGKEEKEVRFEVKTHG--PKRD |
| zmphya1 | ---------------RHILTLVEDSSVPIVQRMLYLALQGREEKEVRFELKTHG--SKRD |
| atphyb | ---------------SLVSDLIYKENEATVNKLLSRALRGDEEKNVEVKLKTFS--PELQ |
| atphyd | ---------------SLVRELIYKEYKETVDRLLSCALKGDEGKNVEVKLKTFG--SELQ |
| gmphyb | ---------------SLVHDLVFKESEETVNKLLSR----EEDKNVETKMRTFG--KEHQ |

-continued

| Name/ SEQ ID No | Sequence |
|---|---|
| lephb1 | ---------------SLVHDLLYKESQESAEKLLYNALRGVEGKNVEIKLRTFG--AEQV |
| lephb2 | ---------------SLVHDLVHEESQTTAQNLLRKALRGEEDKNIEIKLRTFG--AEQL |
| npphyB | ---------------SLVHDLVHEESQETAENLLFNALRGEEDKNVEMKLRTFG--SEQP |
| ntphyb | ---------------SLVHDLVHKESQETAEKLLFNALRGEEDKNVEIKLRTFG--PEQL |
| osphyb | ---------------SLVNDLIFKESEETVNKLLSRALRGDEDKNVEIKLKTFG--PEQS |
| pbphyb1 | ---------------SLVHDLVYKEYEETVDKLLHRALRGEEDKNVEIKLRTFG--SEHQ |
| pbphyb2 | ---------------SLVHDLVYKEYEEIVDKLIHRAVKGEEDKNVEIKLRTFC--SEHQ |
| sbphyB | ---------------SLVNDLIFKESEEIVEKLLSRALRGEEDKNVEIKLKTFG--SEQS |
| slphyb | ---------------SLVHDLVCEDSKNVTQELLLHALQGDEDKNVEIKLKAFG--SQQH |
| stphyb1 | ---------------SLVHDLVYKESQETAEKLLYNALRGEEDKNVEIKLRTFG--AEQL |
| stphyb2 | ---------------SLVHDLVYKESQETAEKLLYNALRGEEDKNVEIKLRTFG--AEQL |
| zmphyb1 | ---------------SLVNDLIFKESEATVEKLLSRALRGEEDKNVEIKLKTFG--SEQS |
| zmphyb2 | ---------------SLVNDLIFKECDDIVEKLLSRALRGEEDKNVEIKLKTFG--SEQS |
| atphyc | ---------------KPVSDLVEDDSVETVKNMLALALEGSEERGAEIRIRAFG--PKRK |
| osphyc | ---------------KPLVDLVIDDSVEVVKQILNSALQGIEEQNLQIKLKTFN--HQEN |
| sbphyc | ---------------RPLIDLVVVDSIEVVKRILDSALQGIEEQNLEIKLKAFH--EQEC |
| slphyc | ---------------SQLVDVVVEGTVEVLKNILSSALQGTEEKNVEIRLRTLG--SHGK |
| taphyc | ---------------MLLVDLVEGDSVEVVKQMLNSALQGTEEQNLEIKLKTMH--QQES |
| zmphyc1 | ---------------RPLIDLVVTDSIEVVKQILDSALQGIEEQNMEIKLKTFH--EHEC |
| zmphyc2 | ---------------RPLIDLVVADSVEVVKQILDSALQGIEEQNLEIKLKTFH--EQEC |
| lephye | ---------------SLINDITHEDSRGTVEKVLHRALLGEEEKNVEIKLRRFG--KDPP |
| atphye | ---------------SLADEIVQEESRAALESLLCKALQGEEEKSVMLKLRKFG--QNNH |
| inphye | ---------------YLIDDVTHEDSHETFKALMCRALQGEEDRNVEVKLLKFG--NHPT |
| lephyf | ---------------VPLVDLVIGGTTNTIKRVLSLALQGKEEKNVEIKLRTLG--PQEK |
| acvphy1 | ---------------SLAKELVREESKTIVERVLRLALEGEEEQDIEIHLRTYD--QHKQ |
| acvphy2 | ---------------SLVRDVVVNASMETAERVLDLALQGQEEQNVEIKLKTYG--DQAI |
| acvphy3 | NCRFLQGPDTNPADVASIREALAQGTGTFCGRLLNYRKDGSSFWNLLTIAPIKDDL---- |
| apphy1 | ---------------SLIRDLVVDEAVESVERLLYLALQGEEEQNVEIKLKTYG--DQAE |
| cpphy2 | ---------------SLVKDLVLDESVVVVERLLYLASQGEEEQNVEIKLKTFG--TQTE |
| mcphy1 | ---------------SLVKDLVQRESREAVERVLYMALNGEEEQNVEIQLKTWGPQLHSH |
| mpphy1 | ---------------SLVKDLALEESVETVERLLYLALQGEEEQNVEIKLQTYG--AQKD |
| msphy1 | ---------------SLVKDLTHPSSKDTVEKLLYMALNGEEEQNVEIRLKTWG--MQQG |
| paphy1 | ---------------PLI-DLVQHDSVEIVKKMLYLALQGEEEQNVEIKLKTFG--IQEE |
| ppphy0 | ---------------SLVKDLVTDESVAVVERLLYLALRGEEEQNVEIKLKTFG--TQTE |
| ppphy1 | ---------------SLVKDLVTDESVAVVERLLYLALRGEEEQNVEIKLKTFG--TQTE |
| ppphy2 | ---------------SLVKDLILNESIDVVQRLLHLALQGDEEQNIEIQLKTFG--PQKE |
| ppphy3 | ---------------SLVKDLVMDESLEVVERLLYLALRGEEEQGVEIKLKTFG--AQTV |
| ppphy4 | ---------------SLVKDLILEESIDVVQRLLYLALQGEEEQNIEIQLKTFG--PQKE |
| psphy1 | ---------------SLVQDLVFEQSVERVEKMLHNALRGEEEKNVEMMLKTFG--PQKE |

-continued

| Name/ SEQ ID No | Sequence |
|---|---|
| smphy1 | ---------------SLAKELVLHESADMVERLLYLALQGDEEQNVELKLKTFG--GQKD |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | --------------RAYLLEGHSPASALDRLDTLVSTLLGNHTATALIAVVHPA--GDHA |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ---------------AYCTAPAEFRANLDDLMRNKRSWRGELTLTGGATPQRPLMVRADP |
| rpBphP1N | ---------------GFFVESNDFLRNVAELIDHGRGWRGEVLLRGAGNRPLPLAVRADP |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |

-continued

| Name/ SEQ ID No | Sequence |
|---|---|
| rrBphP | GLTVSLALLGRGQWWVRLSGVPQYDG---------------------------------- |
| rsBphP1 | ISASIGIAMADSIGDLDLVRAADIAMYAAKKNGGNRGELFRPSLYEETTQLVELDNDMRG |
| rsBphP1a | ISASIGIAMADSIGDLDLVRAADIAMYAAKKNGGNRGELFRPSLYEETTQLVELDNDMRG |
| toCphB | ------------------------------------------------------------ |
| xaBphP | RDGAPVYRQFHLEPLPSPSSITAHWLLQLRDPE--------------------------- |
| xcBphP | SDGAPVYRQFHLEPLPSPSGVTAHWLLQLRDPE--------------------------- |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | SP-------------HWSNESKISINTVWNDTYLQNTQGGRYRYNETFAVDDIYKVGFTQ |
| cph2 | QEPFFLQGQPIYLTASMGISTAPYDGETAESLLKFAEIALTRAKCQGKNTYQFYRPQDSA |
| npCph2a1 | SP-------------YWSNESEIGINTVWNDTYLQDTEGGRYRNNETFAVDDIYKMGFAK |
| npCph2a2 | NP-------------RWGRSIKLGVGMVWDDTYLQETQGGRYRNNETFVVDDIHSQGFTQ |
| npCph2b | ----------------WQSVLGVNA----PPECFPNEHRDLYSQGRVRAINNVSTDSLSD |
| arphyA | A-----GPISLVVNACASRDLHENVVGVCFVAHDLTGQKTVMDKFTRIEGDYKAIIQNPN |
| asphya3 | D-----GPVILVVNACASRDLHDHVVGVCFVAQDMTVHKLVMDKFTRVEGDYKAIIHNPN |
| asphya4 | D-----GPVILVVNACASRDLHDHVVGVCFVAQDMTVHKLVMDKFTRVEGDYKAIIHNPN |
| atphya | A-----GPISLVVNACASRDLHENVVGVCFVAHDLTGQKTVMDKFTRIEGDYKAIIQNPN |
| cpphya | V-----GSISLVVNACASRDLRENVVGVFFVAQDITGQKMVMDKFTRLEGDYKAIVQNPN |
| cupphya | C-----GPISLVVNACASRDVQESVVGVCFIAQDITGQKTVMDKFTRIEGDYRAIIQNPN |
| gmphya | S-----GPISLVVNRCASRDLRDNVVGVCFVAHDITAQKNVMDKFIRIEGDYKAIVQNRN |
| lephya | S-----SPISLIVNACASKDVRDNVVGVCFMAHDITGQKSIMDKFTRIEGDYRAIIQNPH |
| lsphya | F-----GPISLIVNACASRDLRENVVGVCFVAQDITAQKTVMDKFTRIEGDYKAIVQNPN |
| mgphya | S-----GPISLVVNACASRDHHENVVGVCFVAQDITGHKTVMDKFTRIEGDYKAIVQNPN |
| ntphya | S-----SPISLIVNACASRDVGDSVVGVCFIAQDITGQKNIMDKFTRIEGDYRAIIQNPH |
| omphya | S-----GPISLIVNACASKDVKENVVGVCFIAQDITTQKSMMDKFTRIEGDYRSIIQNPN |
| osphya | D-----GPVILVVNACASRDLHDHVVGVCFVAQDMTVHKLVMDKFTRVEGDYKAIIHNPS |
| pcphya | S-----VPITVVVNACATRGLHDNVVGVCFVAQDVTSQKTIMDKFTRIQGDYKAIVQNPN |
| psphya | S-----GPISLIVNACASKDLRENVVGVCFVAQDITAQKTVMDKFTRIEGDYKAIVQNPN |
| sbphya | D-----GPVILVVNACASRDLHDHVVGVCFVAQDMTVHKLVMDKFTRVEGDYKAIIHNPN |
| slphya1 | S-----GPISLIVNACASKDVNGNVVGVCLIAQDITGQKTVMDKFLRIEGDYKAIIQSPN |
| slphya3 | S-----SPISLVVNACASKDVNGNVVGVCLITQDITGQKTVMDKFTRIEGDYKAIIQSPN |
| slphya4 | S-----GPISLVVNACASKDVNGNVVGVCLIAQDITGQKTVMDKFTRIEGDYKAIIQSPN |

-continued

| Name/ SEQ ID No | Sequence |
|---|---|
| stphya | S-----SPISLIVNACASKDVRDSVVGVCFIAQDITGQKSIMDKFTRIEGDYRAIIQNPH |
| taphya | D-----GPVILVVNACASRDLHDDVVGVCFVAQDMTVHKLVMDKFTRVEGDYMAIIHNPN |
| zmphya1 | D-----GPVILVVNACASRDMHDHVVGVCFVAQDMTVHKLVMDKFTRVEGDYRAIIHNPN |
| atphyb | G-----KAVFVVVNACSSKDYLNNIVGVCFVGQDVTSQKIVMDKFINIQGDYKAIVHSPN |
| atphyd | G-----KAMFVVVNACSSKDYLNNIVGVCFVGQDVTGHKIVMDKFINIQGDYKAIIHSPN |
| gmphyb | N-----KAAFLVVNACSSKHFTNNVVGVCFVGQNVTGQKIVMHKFINIQGDYKAIVHSPN |
| lephb1 | E-----KAVFLVVNACSSRDYTNSIVGVSFVGQDVTGEKIVMDKFIHIQGDYKAIVHSPN |
| lephb2 | K-----KTVFVEVNACSNKDYTNNIVGVSFIGQDITAQKVVLDKFVRIQGDYKAIMHSPN |
| npphyB | K-----KAVFVVVNACSSKDYTNNIVGVCFVGQDVTGQKVVMDKFIHIQGDYKAIVHSPN |
| ntphyb | K-----KAVFVVVNACSSKDYTNNIVGVCFVGQDVTGQKVVMDKFIHIQGDYKAIVHSPN |
| osphyb | K-----GPIFVIVNACSTRDYTKNIVGVCFVGQDVTGQKVVMDKFINIQGDYKAIVHNPN |
| pbphyb1 | K-----KALFVVVNACSSKDYMNNIVGVCFVGQDVTGQKVVMDKYVHIQGDYKAIVHSPN |
| pbphyb2 | K-----KAVFVVVNACSSKDYMDNIVGVCFVGQDITGQKVVMDKYVLIQGDYKAIVHSPN |
| sbphyB | N-----GAIFVIVNACSSRDYTQNIVGVCFVGQDVTGQKVVMDKFINIQGDYKAIVHNPN |
| slphyb | K-----KAVYVVVNACCSKDYTNKIVGVCFVGHDVTGQKNVMDKFVNIQGDYKAIVHSPS |
| stphyb1 | E-----KAVFVVVNACA-RDYTNNIVGVCFVGQDVTGEKVVMDKFINIQGDYKAIVHSPN |
| stphyb2 | E-----KAVFVVVNACASKDYTNNIVGVCFVGQDVTGEKVVMDKFINIQGDYKAIVHSPN |
| zmphyb1 | K-----GPIFVVVNACSSRDYTQNIVGVCFVGQDVTGQKVVMDKFVNIQGDYKAIVHNPN |
| zmphyb2 | K-----GAIFVIVNACSSRDYTQNIVGVCFVGQDVTGQKVVMDKFINIQGDYKAIVHNPN |
| atphyc | S-----SPVELVVNTCCSRDMTNNVLGVCFIGQDVTGQKTLTENYSRVKGDYARIMWSPS |
| osphyc | N-----GPVILMVNACCSRDLSEKVVGVCFVAQDMTGQNIIMDKYTRIQGDYVAIVKNPS |
| sbphyc | N-----GPIILMVNSCCSRDLSEKVIGVCFVGQDLTTQKMIMDKYTRIQGDYVAIVKNPS |
| slphyc | T-----SYVVLVVNACCSRDVDENVTGICFVGQDVTEEKRIVDQITELQGDYSGIMRNPC |
| taphyc | K-----GPVVLMVNACCSRDLSDKVVGVCFVAQDLTGHKMVMDKYTRIQGDYVAIVKNPN |
| zmphyc1 | N-----GPVILKVNSCCSRDLSEKVIGVCFVAQDLTRQKMIMDKYTRIQGDYVAIVKNPT |
| zmphyc2 | C-----GPVILMINSCCSRDLSEKVIGVCFVAQDLTRQKMIMDKYTRIQGDYVAIIKNPS |
| lephye | -----GSVIYLVINACTSRDHKNGVVGVSFVAQDVTPEKFIMDKFIQLRGDYEAIVQSLS |
| atphye | PDY--SSDVCVLVNSCTSRDYTENIIGVCFVGQDITSEKAITDRFIRLQGDYKTIVQSLN |
| inphye | -----KEVVYLVVNACTSRDYKNDIIGVCFVGQDITPEKAVMDKFVRLQGDYEAIIQSLN |
| lephyf | V-----GSISIVVNACCSRDFKQNIVGVCFTGKDVTGLKLIKDKYSRVQGDYVGIIHSPS |
| acvphy1 | K-----GVVILIVNTCCSRDVSNNVVGVCFVGQDVTGQKLVLDRFIRIQGDYKAIVQSLN |
| acvphy2 | K-----GPVILIVNACSSRDFTDNVVGVCFVGQDVTGQKVVMDKFTRIQGDYKTIVQNPN |
| acvphy3 | ------GSIVKLIGVQLEVSKYTEGIRANNRRPNGMPQSLIRYDVRHQDKVSAFIAQLVA |
| apphy1 | K-----GPVILVVNACSSRDFTENVVGVCFVGQDVTGQKVVMDKFTRIQGDYKTIVQSPN |
| cpphy2 | K-----EAVILIVNACSSRDVSDSVVGVCFVGQDVTGQKMFMDKFTRIQGDYKTIVKNPH |
| mcphy1 | G-----GTVILVVNACASRDVSESVVGVCFVGQDVTGEKEVLDKFIRIQGDYTTIVRSRN |
| mpphy1 | K-----GAVILIVNACSSRDVTENVVGVCFVGQDVTGQKVVMDKFTRIQGDYKAIVQNPN |
| msphy1 | K-----GPVILMVNACASRDVSEKVVGVCFVAQDVTGEKIVQDKFTRIQGDYTTIVRSHN |

-continued

| Name/ SEQ ID No | Sequence |
|---|---|
| paphy1 | K-----GPVVLIVNACSSRDLEENVVGVCFVAQDVTWQRIAMDKFTHLQGDYRAIVQNPN |
| ppphy0 | K-----GVVILIVDACSSIHVSENVVGVCFVGQDVTGQKMFMDKFTRIQGDYKTIVQNPH |
| ppphy1 | K-----GVVILIVDACSSIHVSENVVGVCFVGQDVTGQKMFMDKFTRIQGDYKTIVQNPH |
| ppphy2 | K-----GAVILIVNACSSRDVQDNVVGVCFVGQDVTGQKQVLDKFTRIQGDYKAIVQNPN |
| ppphy3 | K-----GAVTLIVNACASRDVSENVVGVCFVGQDVTGQKMFMDKFTRIQGDYKTIVQNPH |
| ppphy4 | K-----GAVILIVNACSSRDVQDNVVGVCFVGQDVTGQKQVLDKFTRIQGDYKAIVQNPN |
| psphy1 | K-----EAVILVVNACSSRDFTDNIVGVCFVGQDVTSQKVVMDKFIRIQGDYRSIVQSPN |
| smphy1 | K-----EAVILVVNACASRDVSDNVVGVCFVGQDVTGQKVVMEKFTRIQGDYKAIVQNPN |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphP | ------------------------------------------------------------ |
| goBphP | ------------------------------------------------------------ |
| krBphP | ---------------------------------DGGGVDPGRDPGPRVDDGAATIELASA |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | VIAPHDRVLGFVLIFSDLTERKTAEAARARFQEEIDGARRPSLRLDQSASLIYKELAAST |

-continued

| Name/ SEQ ID No | Sequence |
|---|---|
| rpBphP1N | VTRTEDQSLGFVLIFSDATDRRTADAARTRFQEGILASARPGVRLDSKSDLLHEKLLSAL |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | A-----IESEQFHLVYQPIFALNPETERLVGFEALLRWDHPLHGALQPGIFIPLAERLGH |
| rsBphP1a | A-----IESEQFHLVYQPIFALNPETERLVGFEALLRWDHPLHGALQPGIFIPLAERLGH |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | CHVENLEQFQIYAFVLAPIFVGQKLWGLLATYQHSGPRQWKPSEVNFLTQIAAQLGIALQ |
| cph2 | PMLDRLTLESDLRQALTNQEFVLYFQPQVALDTGKLLGVEALVRWQHPRLGQVAPDVFIP |
| npCph2a1 | CHIDNLEQFQIHAFVLAPIFVGQKLWGLLATYQHTGPRQWKASEVNFLSQIAAQMGVALQ |
| npCph2a2 | CHIEILEQFHVQAFMIAPIFVGQELWGLLGAYQHSSTRHWQASEIEFFTQIATQLGVALQ |
| npCph2b | CHREFLQSLQIQANLTVPINIGIELWGLLIAHECNTPRNWQDVEIDLLQQLGDQAAIAIQ |
| arphyA | PLIPPIFGTDEFGWCTEWNPAMSKLT----GLKR-----------------------EEV |
| asphya3 | PLIPPIFGADEFGWCSEWNAAMTKLT----GWNR-----------------------DEV |
| asphya4 | PLIPPIFGADEFGWCSEWNAAMTKLT----GWNR-----------------------DEV |
| atphya | PLIPPIFGTDEFGWCTEWNPAMSKLT----GLKR-----------------------EEV |
| cpphya | PLIPPIFGSDEFGWCSEWNPAMAKLT----GWSR-----------------------EEV |
| cupphya | PLIPPIFGTDEFGWCSEWNSAMTKLS----GWRR-----------------------DEV |
| gmphya | PLIPPIFGTDEFGWCCEWNPAMMKLT----GWKR-----------------------EEV |
| lephya | PLIPPIFGTDQFGWCSEWNTAMTKLT----GWRR-----------------------DDV |
| lsphya | QLIPPIFGTDEFGWCCEWNAAMIKLT----GWKR-----------------------EEV |
| mgphya | PLIPPILGTDEFGWCSEWNLAMEKIS----GWNR-----------------------EDV |
| ntphya | PLIPPIFGTDQFGWCSEWNSAMTKLT----GWRR-----------------------DDV |
| omphya | PLIPPIFGTDEFGWCSEWNAAMIKLS----GWGR-----------------------EAV |

-continued

| Name/ SEQ ID No | Sequence |
|---|---|
| osphya | PLIPPIFGADEFGWCSEWNAAMTKLT----GWHR-----------------------DEV |
| pcphya | PLIPPIFGTDEFGWCSEWNQAMTELS----GWRR-----------------------EDV |
| psphya | QLIPPIFGTDEFGWCCEWNAAMIKLT----GWKR-----------------------EEV |
| sbphya | PLIPPIFGADQFGWCSEWNVAMTKLT----GWHR-----------------------DEV |
| slphya1 | PLIPPIFGTDEFGWCSEWNPAMAKLT----GWTR-----------------------EEV |
| slphya3 | PLIPPIFGTDEFGWCSEWNPAMAKLT----GWSR-----------------------EEV |
| slphya4 | PLIPPIFGTDEFGWCSEWNPAMAKLT----GWSR-----------------------EEV |
| stphya | PLIPPIFGTDQFGWCSEWNSAMTMLT----GWRR-----------------------DDV |
| taphya | PLIPPIFGADESGWCCEWNAAMTKLT----GWHR-----------------------EEV |
| zmphya1 | PLIPPIFGADQFGWCSEWNAAMTKLT----GWHR-----------------------DEV |
| atphyb | PLIPPIFAADENTCCLEWNMAMEKLT----GWSR-----------------------SEV |
| atphyd | PLIPPIFAADENTCCLEWNTAMEKLT----GWPR-----------------------SEV |
| gmphyb | PLIPPIFASDDNTCCLEWNTAMEKLD----PSNENVTV-----------------GGVDV |
| lephb1 | PLIPPIFASDENTSCSEWNTAMEKLS----GWSR-----------------------EEI |
| lephb2 | PLIPPIFVSDENTCCFEWNTAMEKLS----GWNK-----------------------EEI |
| npphyB | PLIPPIFVSDENTCCSEWNTAMENLT----GWSR-----------------------GEI |
| ntphyb | PLIPPIFASDENTCCSEWNTAMEKLT----GWSR-----------------------GEI |
| osphyb | PLIPPIFASDENTCCSEWNTAMEKLT----GWSR-----------------------GEV |
| pbphyb1 | PLIPPIFASDENTCCLEWNTAMEKFT----GWSR-----------------------GEV |
| pbphyb2 | PSIPPIFASDENTCCLEWNTAMEKLT----GWSR-----------------------GEV |
| sbphyB | PLIPPIFASDENTSCSEWNTAMEKLT----GWSR-----------------------GEV |
| slphyb | PLIPPIFASDENSCCTEWNTAMEILT----GYGK-----------------------EDV |
| stphyb1 | PLIPPIFASDENTCCSEWNTAMEKLT----GWSR-----------------------GEI |
| stphyb2 | PLIPPIFASDENTCCSEWNTAMEKLT----GWSR-----------------------GEI |
| zmphyb1 | PLIPPIFASDENTSCSEWNTAMEKLT----GWSR-----------------------GEV |
| zmphyb2 | PLLPPIFASDENTSCSEWNTAMEKLT----GWSR-----------------------EEV |
| atphyc | TLIPPIFITNENGVCSEWNNAMQKLS----GIKR-----------------------EEV |
| osphyc | ELIPPIFMINDLGSCLEWNEAMQKIT----GIKR-----------------------EDA |
| sbphyc | ELIPPIFMINDLGSCLEWNKAMQKIT----GIQR-----------------------EDV |
| slphyc | HLIPPIFLIDDQGVGLEWNDAMAKIS----GLSK-----------------------EYT |
| taphyc | ELIPPIFMINDLGSCLEWNEAMQKIT----GIKR-----------------------EDA |
| zmphyc1 | ELIPPIFMINDLGSCLEWNKAMQKIT----GIKR-----------------------EDA |
| zmphyc2 | ELIPPIFMINDLGSCLEWNKAMQKIT----GMKR-----------------------EDA |
| lephye | PLIPPIFASDENACCSEWNAAMERLT----GWTK-----------------------YEV |
| atphye | PLIPPIFASDENACCSEWNAAMEKLT----GWSK-----------------------HEV |
| inphye | PLIPPIFASDENACCSEWNAAMERLT----GLVK-----------------------CEV |
| lephyf | PLIPPIFVMDEQGRCVEWNDAMHKLT----GSKR-----------------------EEV |
| acvphy1 | PLIPPIFGADEYGFCSEWNAAMEKLS----NWRR-----------------------EEV |
| acvphy2 | PLIPPIFGADEFGYCSEWNPAMEKFS----GWKR-----------------------EDV |

-continued

| Name/ SEQ ID No | Sequence |
|---|---|
| acvphy3 | ALTKPDKVETPRLSSAMRFSLTGQTIESLPQPTAIPREGGGRTRRPRSSSFLSLLGMEKE |
| apphy1 | PLIPPIFGADEFGFCSEWNPAMEKLS----GWKR-----------------------EDV |
| cpphy2 | PLIPPIFGGDEYGYCFEWNPAMEALT----GWKH-----------------------DEV |
| mcphy1 | SLIPPIFGSDEYGCCTEWNPAMEKLT----GVRR-----------------------EDV |
| mpphy1 | PLIPPIFGSDEFGYCSEWNPAMEKLA----GWKR-----------------------EEV |
| msphy1 | SLIPPIFGSDESGFCVEWNPAMERLS----GVKR-----------------------EEA |
| paphy1 | PLIPPIFGADEYGYCSEWNPAMEKLT----GWKR-----------------------EEV |
| ppphy0 | PLIPPIFGADEFGYCFEWNPAMEGLT----GWKK-----------------------DEV |
| ppphy1 | PLIPPIFGADEFGYCFEWNPAMEGLT----GWKK-----------------------DEV |
| ppphy2 | PLIPPIFGTDEYGYCSEWNPSMEKLT----GWKR-----------------------EEV |
| ppphy3 | PLIPPIFGADEFGYCFEWNPAMEGLT----GWKR-----------------------DEV |
| ppphy4 | PLIPPIFGTDEYGYCSEWNPSMEKLT----GWKR-----------------------EEV |
| psphy1 | PLIPPIFASDEYACCSEWNAAMEKVT----GWTH-----------------------DEV |
| smphy1 | PLIPPIFGADEFGYCSEWNPAMEKLS----GWRR-----------------------EEV |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | GHLPPLLVDAAGTSVVHVPSRPMLGL----GFGP----------------------TAGL |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |

-continued

| Name/ SEQ ID No | Sequence |
|---|---|
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | VENAQLAALEVTHGAEAGSMPEMLESIRNSTARTLGILEHLVWYRSQSEE---------- |
| rpBphP1N | VENAQLAALEITYGVETGRIAELLEGVRQSMLRTAEVLGHLVQHAARTAGSDSSSNGSQN |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | IHAMGNWVLRRAILQLQAFRSAGPELDLKMNVNVSPLQLARPDFLARLADLLAQVPDLPR |
| rsBphP1a | IHAMGNWVLRRAILQLQAFRSAGPELDLKMNVNVSPLQLARPDFLARLADLLAQVPDLPR |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | QAELL------------------------------------------------------- |
| cph2 | LAEELGLINHLGQWVLETACATHQHFFRETGRRLRMAVNISARQFQDEKWLNSVLECLKR |
| npCph2a1 | QAELLTQTRQQTLNLQQAAEQQ------------RVLF-----------EVVAKVRKSLD |
| npCph2a2 | QAEYLEQVRAQTRKLALVAEQQ------------QTLA-----------SVITKIRESLD |
| npCph2b | QAQLYEQTCKAE------------------------------------------------ |
| arphyA | ID---------------------------------------------------------- |
| asphya3 | LD---------------------------------------------------------- |
| asphya4 | LD---------------------------------------------------------- |
| atphya | ID---------------------------------------------------------- |
| cpphya | ID---------------------------------------------------------- |
| cupphya | ID---------------------------------------------------------- |

-continued

| Name/ SEQ ID No | Sequence |
|---|---|
| gmphya | MD---------------------------------------------------------- |
| lephya | MD---------------------------------------------------------- |
| lsphya | MD---------------------------------------------------------- |
| mgphya | IN---------------------------------------------------------- |
| ntphya | ID---------------------------------------------------------- |
| omphya | ID---------------------------------------------------------- |
| osphya | IN---------------------------------------------------------- |
| pcphya | MN---------------------------------------------------------- |
| psphya | MD---------------------------------------------------------- |
| sbphya | ID---------------------------------------------------------- |
| slphya1 | ID---------------------------------------------------------- |
| slphya3 | ID---------------------------------------------------------- |
| slphya4 | ID---------------------------------------------------------- |
| stphya | MD---------------------------------------------------------- |
| taphya | LD---------------------------------------------------------- |
| zmphya1 | ID---------------------------------------------------------- |
| atphyb | IG---------------------------------------------------------- |
| atphyd | IG---------------------------------------------------------- |
| gmphyb | IG---------------------------------------------------------- |
| lephb1 | VG---------------------------------------------------------- |
| lephb2 | IG---------------------------------------------------------- |
| npphyB | IG---------------------------------------------------------- |
| ntphyb | IG---------------------------------------------------------- |
| osphyb | VG---------------------------------------------------------- |
| pbphyb1 | IG---------------------------------------------------------- |
| pbphyb2 | VG---------------------------------------------------------- |
| sbphyB | VG---------------------------------------------------------- |
| slphyb | IG---------------------------------------------------------- |
| stphyb1 | VG---------------------------------------------------------- |
| stphyb2 | VG---------------------------------------------------------- |
| zmphyb1 | VG---------------------------------------------------------- |
| zmphyb2 | VG---------------------------------------------------------- |
| atphyc | VN---------------------------------------------------------- |
| osphyc | VD---------------------------------------------------------- |
| sbphyc | ID---------------------------------------------------------- |
| slphyc | VG---------------------------------------------------------- |
| taphyc | ID---------------------------------------------------------- |
| zmphyc1 | IN---------------------------------------------------------- |

-continued

| Name/<br>SEQ ID No | Sequence |
|---|---|
| zmphyc2 | IN---------------------------------------------------------- |
| lephye | MG---------------------------------------------------------- |
| atphye | IG---------------------------------------------------------- |
| inphye | IG---------------------------------------------------------- |
| lephyf | ID---------------------------------------------------------- |
| acvphy1 | LG---------------------------------------------------------- |
| acvphy2 | IG---------------------------------------------------------- |
| acvphy3 | KDIPEEDELQELEVIMLEDASVGRPGSLDDPERTRRGIDLATTLERIGKSFVITDPRLPD |
| apphy1 | LG---------------------------------------------------------- |
| cpphy2 | VG---------------------------------------------------------- |
| mcphy1 | IG---------------------------------------------------------- |
| mpphy1 | IG---------------------------------------------------------- |
| msphy1 | IG---------------------------------------------------------- |
| paphy1 | IG---------------------------------------------------------- |
| ppphy0 | VG---------------------------------------------------------- |
| ppphy1 | VG---------------------------------------------------------- |
| ppphy2 | IG---------------------------------------------------------- |
| ppphy3 | IG---------------------------------------------------------- |
| ppphy4 | LG---------------------------------------------------------- |
| psphy1 | IG---------------------------------------------------------- |
| smphy1 | LG---------------------------------------------------------- |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | VS---------------------------------------------------------- |
| mmBphP2 | ------------------------------------------------------------ |
| paBphP | ------------------------------------------------------------ |

-continued

| Name/ SEQ ID No | Sequence |
|---|---|
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | KK---------------------------------------------------------- |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | HALCLEITETSLSDEAVSEALISIRALGVRIAIDDFGTGFSSLACLRRLPVDVAKLDRAF |
| rsBphP1a | HALCLEITETSLSDEAVSEALISIRALGVRIAIDDFGTGFSSLACLRRLPVDVAKLDRAF |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | ------------------------------------------------------------ |
| cph2 | TGMPPEDLELEITESLMMEDIKGTVVLLHRLREEGVQVAIDDFGTGYSSLSILKQLPIHR |
| npCph2a1 | LDAIFQTTTQEICKSLQADRVAVFQFQADWSGEYIAEFVGDGWVKLVGSNTKTVWQDSYL |
| npCph2a2 | LNAIFETTTQELRRVLNCDRVVIFRFYSE-SNYDGGEVIAEDVAERFLSTLTAKVYDRCL |

-continued

| Name/ SEQ ID No | Sequence |
|---|---|
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |

-continued

| Name/ SEQ ID No | Sequence |
|---|---|
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | NPIIFASDRFLELTEYTREEVLGNNCRFLQGRGTDRKAVQLIRDAVKEQRDVTVQVLNYT |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |

-continued

| Name/ SEQ ID No | Sequence |
|---|---|
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | LGGGHTAAQDHRFFAAVTGLVHAADLKVVQEGIETLDQLALVRAAGADFAQGFHLAAPLS |
| rsBphP1a | LGGGHTAAQDHRFFAAVTGLVHAADLKVVQEGIETLDQLALVRAAGADFAQGFHLAAPLS |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |

-continued

| Name/ SEQ ID No | Sequence |
|---|---|
| ncFPH2 | ------------------------------------------------------------ |
| umFPH1 | ------------------------------------------------------------ |
| aphC | ------------------------------------------------------------ |
| cph2 | LKIDKSFVNDLLNEGADTAIIQYVIDLANGLNLETVAEGIESEAQLQRLQKMGCHLGQGY |
| npCph2a1 | QETQGGRYRHNETFAVDDIYQVGHSQCHVAVLEQIQARAYAIAPIFIGQQLWGLLAAYQN |
| npCph2a2 | GQEHIEKFCQGYVHAVTDIYNSELNECYVSMLSRFQVRANLVIPMLKQGQLWGLLGIHQC |
| npCph2b | ------------------------------------------------------------ |
| arphyA | -------KMLLGEVFGTQTACCRLKNQEAFVNLGIVLNSAVTSQ-ESEKVSFAFFTRGGK |
| asphya3 | -------KMLLGEVFDSSNASCPLKNRDAFVSLCVLINSALAGE-ETEKAPFGFFDRSGK |
| asphya4 | -------KMLLGEVFDSSNASCPLKNKNAFVSLCVLINSALAGE-ETEKAPFGFFDRSGK |
| atphya | -------KMLLGEVFGTQKSCCRLKNQEAFVNLGIVLNNAVTSQ-DPDKVSFAFFTRGGK |
| cpphya | -------KMLLGEVFGVHKSCCRLKNQEAFVNLGIVLNNAMCGQ-DPEKASFGFLARNGM |
| cupphya | -------KMVLGEVFGTQKACCRLKSHEAFVTLGVVLNNAITGH-ESDKTVFGFCTRNGK |
| gmphya | -------KMLLGEIFGTQMAACRLKNQEAFVNLGVVLNKAMTGS-ETEKVPFGFFARNGK |
| lephya | -------KMLLGEVFGTQAACCRLKNQEAFVNFGVVLNNAITGQ-ESEKIPFGFFARYGK |
| lsphya | -------KMLLGEVFGTQMSCCRLKNQEAFVNFGIVLNKAMTGL-ETEKVAFGFFSRKGK |
| mgphya | -------KMLLGEVFGTHVVCCRLKNQEAFVNLGIVLNNAVTGR-ESEKISFGFFARNGK |
| ntphya | -------KMLLGEVFGTQAACCRLKNQEAFVNFGVVLNNAMTGQ-ECAKISFGFFARNGK |
| omphya | -------KMLLGEVFGLNKACCRLKNQEAYVNLGVVLNNTVTGQ-ESGKVSFGFFSRSGK |
| osphya | -------KMLLGEVFDSTNASCLVKNKDAFVSLCILINSALAGD-ETEKAPFSFFDRNGK |
| pcphya | -------KMLLGEIFGIQTSCCHLKSKEAFVNLGVVLNNALTGQ-ISEKICFSFFATDGK |
| psphya | -------KMLLGEVFGTQMSCCRLKNQEAFVNFGIVLNKAMTGL-ETEKVPFGFFSRKGK |
| sbphya | -------KMLLGEVFDSSNASCLLKSKDDFVRLCIIINSALAGE-EAENAPFGLFDRNGK |
| slphya1 | -------KMLLGEVFGMHKSCCRLKNQEAFVNLGVLLNGAMSGQ-NIEKLSIGFFTRSGK |
| slphya3 | -------KMLLGEVFGTQKSCCRLKNQEAFVNFGIILNGAMSGQ-NTDKLPIEFFTRFGK |
| slphya4 | -------KMLLGEVFGTHKSCCRLKNQEAFVNFGIILNGAMSGQ-NTDKLPIEFFTRFGK |
| stphya | -------KMLLGEVFGTQAACCRLKNQEAFVNFGVILNNAITGQ-ESEKIPFGFFARYGK |
| taphya | -------KMLLGEVFDSRNASCLLKNKDAFVSLCVVINSALAGE-ETEKAPFGFFDRSGK |
| zmphya1 | -------RMLLGEVFDSSNASCLLKSKDAFVRLCIIINSALAGE-EAEKAPIGFFDRDGK |
| atphyb | -------KMIVGEVFG---SCCMLKGPDALTKFMIVLHNAIGGQDT-DKFPFPFFDRNGK |
| atphyd | -------KLLVREVFG---SYCRLKGPDALTKFMIVLHNAIGGQDT-DKFPFPFFDRKGE |
| gmphyb | -------KMLVGEVFG---SCCQLKGSDSITKFMIVLHNALGGQDT-DKFPFSFLDRHGK |
| lephb1 | -------KMLVGEIFG---SCCRLKGPDAMTKFMIVLHNAIGGQDT-DKFPFSFFDRNGK |
| lephb2 | -------KMLVGEIFG---TFCRLKGPDDMTNFMIMLHKAIGGQEI-DKFPFSFSDRNGK |
| npphyB | -------KMLVGETFG---SCCRLKGPDAMTKFMIVLHNAIGGQDT-DKFPFSFSDRNGK |
| ntphyb | -------KMLVGEIFG---SCCRLKGPDAMTKFMIVLHNAIGVQDT-DKFPFSFFDRNGK |
| osphyb | -------KLLVGEVFG---NCCRLKGPDALTKFMIVLHNAIGGQDC-EKFPFSFFDKNGK |
| pbphyb1 | -------KMLVGEVFG---SCCQLKGSDALTKFMIALHNAIGGQDT-DKLPFSFFDRNGK |

-continued

| Name/ SEQ ID No | Sequence |
|---|---|
| pbphyb2 | -------KMLVGEVFG---SCCRLKGPDALTKFMIALHNAIGGIDT-DKLPFSFFDRNEK |
| sbphyB | -------KFLIGEVFG---SFCRLKGPDALTKFMVVIHNAIGGQDY-EKFPFSFFDKNGK |
| slphyb | -------KTLVGEIFG---SICRLKGHDSLTKFMVVLHNAIGGQDS-DKFPFSFYNRGGR |
| stphyb1 | -------KMLVGEIFG---SCCRLKGPDAMTKFMIVLHNAIGGQDT-DKFPFSFFDRNGK |
| stphyb2 | -------KMLVGEIFG---SCCRLKGPDAMTKFMIVLHNAIGGQDT-DKFPFSFFDRNGK |
| zmphyb1 | -------KFLIGEVFG---NCCRLKGPDALTKFMVIIHNAIGGQDY-EKFPFSFFDKNGK |
| zmphyb2 | -------KFLIGEVFG---NCCRLKGPDALTKFMVVIHNAIEGHDS-EKFPFSFFDKNGK |
| atphyc | -------KILLGEVFTTDDYGCCLKDHDTLTKLRIGFNAVISGQKNIEKLLFGFYHRDGS |
| osphyc | -------KLLIGEVFTHHEYGCRVKDHGTLTKLSILMNTVISGQ-DPEKLLFGFFNTDGK |
| sbphyc | -------KLLIGEVFTLHDYGCRVKDHATLTKLSILMNAVISGQ-DPEKLLFGFFDTDGK |
| slphyc | -------RMLIGEVFTNGNDGCQVKDYETLLRLKIFLSKMIDGE-ESDKVLFGFFDHRKK |
| taphyc | -------KLVIGELFTLHDYGCRVKDQVTLTKLSILMNTVISGQ-EPEKLAFGFFNTDGK |
| zmphyc1 | -------KLLIGEVFTLHDYGCRVKDHATLTKLSILMNAVISGQ-DPEKLFFGFFDTDGK |
| zmphyc2 | -------KLLIGEVFTLHDYGCRVKDHATLTKLSILMNAVISGQ-DPEKLLFGFFGTGGK |
| lephye | -------RTLPGEVFG---GLCRLTGQDALTKFMILFYQAISGHDT-KKLPFGFFNRRGE |
| atphye | -------KMLPGEVFG---VFCKVKCQDSLTKFLISLYQGIAGDNVPESSLVEFFNKEGK |
| inphye | -------KRLPGEIFG---GLCRLKGQDALTKFMILLYQGISGHDT-EKLSFGFFDRKGN |
| lephyf | -------QMLLGEVFTVNSFGCRVKDQDTLTQLTILLNRVIAGG-EGEKLFFGLFNKQDK |
| acvphy1 | -------KMLVGEIFGLQMVCCRLQGQDVVTKLMIVLNDAVNGQES-EKFPLVFYDRNGR |
| acvphy2 | -------KMLIGEVFGSDLACCKLRGQDSMTKFMIILNAAMGGRDS-DRFPFGFFDRYGK |
| acvphy3 | KGGRAFWNLFHLQVMRDENGDVQYFIGVQQEMVAPRPVHQPPELPDILPDRVEQEKAEVV |
| apphy1 | -------KMLVGEVFGTELTCCRLRGQDAMTKFMIVLNTAMGGKDW-DRFPFAFFDHDGK |
| cpphy2 | -------KLLVGEIFGMEMMCCRLKSQDSMTKFMISLNNAMDGTNT-DKFSFSFCNREGK |
| mcphy1 | -------RMLMGDVFG---SALRLRGSDGLTQFMIVLNRAMDGADT-DKFPFTFYDREGK |
| mpphy1 | -------KMLVGEIFGTQMMCCRLKGQDAMTKFMIVLNSAMDGQDS-EKFPFAFFDRQGK |
| msphy1 | -------KMLTRELFG---GILRLKNVDGLTKFMIVLNAAMSSHDT-DKFPFTFYDRSGK |
| paphy1 | -------KMLVGEVFGIHRMSCQLKGQDGLTKLRIVLNNAMAGKET-EKFPFSFFDRHGK |
| ppphy0 | -------KLLVGEIFGMQMMCCRMKSQDAMTKFMIALNTAMDGQST-DKFTFSFFDREGK |
| ppphy1 | -------KLLVGEIFGMQMMCCRMKSQDAMTKFMIALNTAMDGQST-DKFTFSFFDREGK |
| ppphy2 | -------KLLVGEIFGIQLMCCRLKSQDAMTKFMIVLNGAMDGQDT-DRFPFSFFDRQGK |
| ppphy3 | -------KLLVGEIFGMQKMCCQMKSQDAMTKFMISLNSAMDGQNT-DKFSLSFFDREGR |
| ppphy4 | -------KLLVGEIFGMQLMCCRLKGQDAMTKFMIALNSAMDGQDT-DRFPFSFFDRQGK |
| psphy1 | -------KMLVGEIFG---GCCRLKGQDAVTKFTIVLHQCNHGQEI-EKFPFAFFDKQGK |
| smphy1 | -------KMLVGEIFGIQMMYCRLKGQDAVTKFMIVLNSAADGQDT-EKFPFAFFDRQGK |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |

-continued

| Name/ SEQ ID No | Sequence |
|---|---|
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | -------ESVRAPLPPGAVLLMYTDGLVERRDAGLEETTGVLAETA-TRAAADLLPRSRG |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | IAAALGLIAASRKE---------------------------------------------- |
| rsBphP1a | IAAALGLIAASRKE---------------------------------------------- |
| toCphB | ------------------------------------------------------------ |
| xaBphP | ------------------------------------------------------------ |
| xcBphP | ------------------------------------------------------------ |

-continued

| Name/ SEQ ID No | Sequence |
|---|---|
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | -------------------------------NQTQQQAQKLTQALHHLQQTQTQLIQTEK |
| cph2 | FLTRPLPAEAMMTYLYYPQILDFGPTPPLPKVALPETETEAGQGNVGDRPLPNSLNRENP |
| npCph2a1 | SAPRHWEASEIKFITQIANQLGVALQQAQLHNQTKEQTEKLTQALHDLKQTQTQLIQTEK |
| npCph2a2 | QKSREWQDSEIEFVRQIAAQLGVALQHVVLLNQTQQQAIQLAQALEHLQQTQAHLLHSEK |
| npCph2b | -------------------------------TEARNKAGELGQTLHKLQETQTRLIQTEK |
| arphyA | YIE----------------------------CLLCVSKKLDREGV--------------- |
| asphya3 | YIE----------------------------CLLSANRKENEGGL--------------- |
| asphya4 | YIE----------------------------CLLSANRKENEGGL--------------- |
| atphya | YVE----------------------------CLLCVSKKLDRKGV--------------- |
| cpphya | YVE----------------------------CLLCVNKILDKDGA--------------- |
| cupphya | YVE----------------------------CLLSVTKRLNQDGA--------------- |
| gmphya | YVE----------------------------CLLSVSKKLDVEGL--------------- |
| lephya | YVE----------------------------CLLCVSKRLDKEGA--------------- |
| lsphya | YVE----------------------------CLLSVSKKIDAEGL--------------- |
| mgphya | YVE----------------------------CILCASKKIDGEGA--------------- |
| ntphya | YVE----------------------------CLLCVSKRLDREGA--------------- |
| omphya | YVA----------------------------CLLCVSKKVDSEGS--------------- |
| osphya | YIE----------------------------CLLSVNRKVNADGV--------------- |
| pcphya | YVE----------------------------CLLCASKKLHGEGT--------------- |
| psphya | YVE----------------------------CLLSVSKKIDAEGL--------------- |
| sbphya | YIE----------------------------CLLSVNRKVNADGV--------------- |
| slphya1 | YIE----------------------------CLLCVNKKLNGEGD--------------- |
| slphya3 | YIE----------------------------CLLCVNKKLDGDGA--------------- |
| slphya4 | YIE----------------------------CLLCVNKKLDGDGA--------------- |
| stphya | YVE----------------------------CLLCVSKRLDKEGA--------------- |
| taphya | YTE----------------------------CLLSVNRRQNEGGL--------------- |
| zmphya1 | YIE----------------------------CLLSVNRKVNADGV--------------- |
| atphyb | FVQ----------------------------ALLTANKRVSLEGK--------------- |
| atphyd | FIQ----------------------------ALLTLNKRVSIDGK--------------- |
| gmphyb | YVQ----------------------------TFLTANKRVNMEGQ--------------- |

-continued

| Name/ SEQ ID No | Sequence |
|---|---|
| lephb1 | YVQ---------------------------ALLTANKRVNMEGD---------------- |
| lephb2 | FVQ---------------------------ALLTANKRVNVDGQ---------------- |
| npphyB | YVQ---------------------------ALLTANKRVNMEGQ---------------- |
| ntphyb | YVQ---------------------------ALLTANKRVNMEGQ---------------- |
| osphyb | YVQ---------------------------ALLTANTRSRMDGE---------------- |
| pbphyb1 | YVQ---------------------------ALLTANKRVNMEGE---------------- |
| pbphyb2 | NVQ---------------------------TLLTANKRVNMEGD---------------- |
| sbphyB | YVQ---------------------------ALLTANTRSKMDGK---------------- |
| slphyb | YVQ---------------------------GLLTANKRTNIDGH---------------- |
| stphyb1 | YVQ---------------------------ALLTRNKRVNMEGD---------------- |
| stphyb2 | YVQ---------------------------ALLTANKRVNMEGD---------------- |
| zmphyb1 | YVQ---------------------------ALLTANTRSKMDGK---------------- |
| zmphyb2 | YVQ---------------------------ALLTANTRSKMDGK---------------- |
| atphyc | FIE---------------------------ALLSANKRTDIEGK---------------- |
| osphyc | YIE---------------------------SLMTATKRTDAEGK---------------- |
| sbphyc | YIE---------------------------SLLTVNKRINAEGK---------------- |
| slphyc | CID---------------------------ALLCATPRFNADRN---------------- |
| taphyc | YME---------------------------SLLTANKRTDAEGK---------------- |
| zmphyc1 | YIE---------------------------SLLTVNKRTDAEGK---------------- |
| zmphyc2 | YIE---------------------------SLLTVNKRTNAEGK---------------- |
| lephye | FLE---------------------------VFLTANKRTDEHGN---------------- |
| atphye | YIE---------------------------ASLTANKSTNIEGK---------------- |
| inphye | FID---------------------------VFITANKRTDERGN---------------- |
| lephyf | YIE---------------------------ALISANKKVDDDGR---------------- |
| acvphy1 | RVE---------------------------ALLIASKRTDADGR---------------- |
| acvphy2 | YAE---------------------------ALLIANKRTDSDGA---------------- |
| acvphy3 | RATAQRVDAAARELPDANLVPDHLFAPHSKVVTPLPHSKTNSSSWFAIRRVQRRLRRGER |
| apphy1 | YVE---------------------------ALLTANKRTVGDGA---------------- |
| cpphy2 | FVE---------------------------ALLSTNKRTNADGV---------------- |
| mcphy1 | CVD---------------------------SLLTANKRTDADGA---------------- |
| mpphy1 | FVE---------------------------ALLTANKRTDSEGA---------------- |
| msphy1 | IVE---------------------------VLLTTSKRCNSEGV---------------- |
| paphy1 | NTE---------------------------ALLSANKRTDAEGI---------------- |
| ppphy0 | YVD---------------------------VLLSTNKRTNADGV---------------- |
| ppphy1 | YVD---------------------------VLLSTNKRTNADGV---------------- |
| ppphy2 | YVD---------------------------PLLTVNKRTDAEGS---------------- |
| ppphy3 | YVD---------------------------ALLSTNKRTNADGA---------------- |
| ppphy4 | YVD---------------------------ALLTVNKRTDAEGS---------------- |

-continued

| Name/ SEQ ID No | Sequence |
|---|---|
| psphy1 | YVE----------------------------ALLTANKRTDADGR--------------- |
| smphy1 | YVE----------------------------ALLTATKRADAEGS--------------- |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | GMA----------------------------AVADRLLTAVPGDAGDDTTLVLVRPAHPA |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | --------------------------------ELGLSRSKD---VAKTLQEEKRRR---- |
| rpBphP5N | ------------------------------------------------------------ |
| rpBphP6N | ------------------------------------------------------------ |

-continued

| Name/<br>SEQ ID No | Sequence |
|---|---|
| rrBphP | -----------------------------RGQLLGFRGTGTDVTPFKRLQEERVRTQR-- |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |
| gzFPH1 | ------------------------------------------------------------ |
| ncFPH1 | ------------------------------------------------------------ |
| ncFPH2 | ------------------------------------------------------------ |
| umFPH1 | ------------------------------------------------------------ |
| aphC | MSSLG------------------------------------------------------- |
| cph2 | WTE-----KLHDYVLLKERLQQRNVK--EKLVLKIANKIRASLNINDILYST-------- |
| npCph2a1 | MSSLG------------------------------------------------------- |
| npCph2a2 | MSSLG------------------------------------------------------- |
| npCph2b | MSGLG------------------------------------------------------- |
| arphyA | ----------------------VTGVFCFLQLASHELQQALHVQRLAERTALKRLKTLAY |
| asphya3 | ----------------------ITGVFCFIHVASHELQHALQVQQASEQTSLKRLKAFSY |
| asphya4 | ----------------------ITGVFCFIHVASHELQHALQVQQASEQTSLKRLKAFSY |
| atphya | ----------------------VTGVFCFLQLASHELQQALHVQRLAERTAVKRLKALAY |
| cpphya | ----------------------VTGFFCFLQLPSHELQQALNIQRLCEQTALKRLRALGY |
| cupphya | ----------------------VIGLFCFLQLASQELQQALHFQKLSEQTATKRLKVLAY |
| gmphya | ----------------------VTGVFCFLQLASPELQQALHIQRLSEQTASKRLNALSY |
| lephya | ----------------------VTGLFCFLQLASHELQQALYVQRLSEQTALKRLKVLAY |
| lsphya | ----------------------VTGVFCFLQLASPELQQALHIQRLSEQTALKRLKVLTY |
| mgphya | ----------------------VTGVFCLLQLASPELQQALHVQRLTEQTALKRFKELAY |
| ntphya | ----------------------VTGLFCFLQLASHELQQALHIQRLSEQTALKRLKVLAY |
| omphya | ----------------------VTGLFCFLQLASPELQQALHIQRISEQTASKRLRVLAY |
| osphya | ----------------------ITGVFCFIQVPSHELQHALHVQQASQQNALTKLKAYSY |
| pcphya | ----------------------VTGIFCFLQLASQELQQALHIQRLTEQTAMKRLKTLSY |
| psphya | ----------------------VTGVFCFLQLASPELQQALHIQRLSEQTALKRLKVLTY |
| sbphya | ----------------------VTGVFCFIHVPSDDLQHALHVQQASEQTAQRRLKAFSY |
| slphya1 | ----------------------VTGVFCFLQLASHDLQHALHIQRLAEQAATKRANVLAY |
| slphya3 | ----------------------VTGVFCFLQLASHDLQHALHIQRLAEQAATKRAKALAY |

-continued

| Name/ SEQ ID No | Sequence |
|---|---|
| slphya4 | ----------------------VTGVFCFLQLASHDLQHALHIQRLAEQAATKRAKALAY |
| stphya | ----------------------VTGLFCFLQLASHELQQALHVQRLSEQTALKRLKVLAY |
| taphya | ----------------------ITGVFCFIHIPSHELQQALQVQQASEQKSLKRLKAFSY |
| zmphya1 | ----------------------VTGVFCFIHVPSDDLQHALHVQQASEQTALRRLKAFSY |
| atphyb | ----------------------VIGAFCFLQIPSPELQQALAVQRRQDTECFTKAKELAY |
| atphyd | ----------------------IIGAFCFLQIPSPELQQALEVQRRQESEYFSRRKELAY |
| gmphyb | ----------------------IIGAFCFLQIMSPELQQALKAQRQQEKEFLGRMKELAY |
| lephb1 | ----------------------TIGAFCFIQIASPELQQALRVQRQQEKKCYSQMKELAY |
| lephb2 | ----------------------IIGAFCFLQIASPELQKTL-MQRQQEKTSNIHMKELAY |
| npphyB | ----------------------IIGAFCFIQIASPELQQALRVQRQQDKKCYSQMKELAY |
| ntphyb | ----------------------IIGAFCFIQIASPELQQALRVQRQQEKKCYSQMKELAY |
| osphyb | ----------------------AIGAFCFLQIASPELQQAFEIQRHHEKKCYARMKELAY |
| pbphyb1 | ----------------------IVGAFCFLQIASNELQQALKVQRQQEKKCSARMKELAY |
| pbphyb2 | ----------------------IIGAFCFLQIASPELQQTLKVQKQQEKKSFARMKELAY |
| sbphyB | ----------------------SIGAFCFLQIASAEIQQAFEIQRQQEKKCYARMKELAY |
| slphyb | ----------------------ITGAFCFLQIASSDLQQALEIQRQQENVCFERMKELAY |
| stphyb1 | ----------------------TIGAFCFIQIASPELQQALRVQRQQEKKCYSQMKELAY |
| stphyb2 | ----------------------TIGAFCFIQIASPELQQALRVQRQQEKKCYSQMKELAY |
| zmphyb1 | ----------------------SIGAFCFLQIASTEIQQAFEIQRQQEKKCYARMKELAY |
| zmphyb2 | ----------------------SIGAFCFLQIASAEIQQAFEIQRQQEKKCYARMKELAY |
| atphyc | ----------------------VTGVLCFLQVPSPELQYALQVQQISEHAIACALNKLAY |
| osphyc | ----------------------ITGALCFLHVASPELQHALQVQKMSEQAAMNSFKELTY |
| sbphyc | ----------------------ITGAICFLHVASPELQHALQVQKMSEQAATNSFKELTY |
| slphyc | ----------------------ITGVLCFLHLPSPELQYSIHMQKVSEKAATSTLKKLTY |
| taphyc | ----------------------ITGALCFLHVASPELQHALQVQKMSEQAATHSFKELTY |
| zmphyc1 | ----------------------ITGALCFLHVASPELQHALQVQKMSEQAATNSFKELTY |
| zmphyc2 | ----------------------ITGALCFLHVASPELQHALEVQKMSEQAATNSFKELTY |
| lephye | ----------------------VCGCFCFLQPMTIDPEASDER--QDSKDSLWKYKEYVY |
| atphye | ----------------------VIRCFFFLQIINKE----SGLSCPELKESAQSLNELTY |
| inphye | ----------------------IIGCFCFLQTMAVDHPQISARDIEDDRECLSTLKEFAY |
| lephyf | ----------------------VTGVLCFLHVPSPELQYAMHVQKLSEQAAKNSLKKLAY |
| acvphy1 | ----------------------ITGVFCFLHTASPELLQALIIKRAKEKVD----KELSY |
| acvphy2 | ----------------------ITGVFCFLHTASPELQQALQVQKRSARTALDRLKEVAY |
| acvphy3 | LGLKHFRPIKPLGSGDTGSVHLVELRGTGQVFALKAMDKSMMLQRNKVHRARAEREILAI |
| apphy1 | ----------------------ITGVFCFLYTASPELQQALQVHKRSARTALERLKEVAY |
| cpphy2 | ----------------------ITGVFCFLQIASSELQQALTVQRATEKVAIAKLKELAY |
| mcphy1 | ----------------------ITGVFCFLHTVSLELQQALSVQKAAERVAEAKAKELAY |
| mpphy1 | ----------------------FTGVFCFLQIASMELLQALTVQRATEKVAFSKLKELAY |
| msphy1 | ----------------------VTGVFCFLHTASSELQQALTVQKAAERVAEVKAKELAY |

-continued

| Name/ SEQ ID No | Sequence |
|---|---|
| paphy1 | ----------------------ITGVFCFLHVTSTELQQALQVQRMAEQAAMDRLKELAY |
| ppphy0 | ----------------------ITGVFCFLQIASSELQQALKVQRATEKVAVAKLKELAY |
| ppphy1 | ----------------------ITGVFCFLQIASSELQQALKVQRATEKVAVAKLKELAY |
| ppphy2 | ----------------------ITGVFCFLHTTSVELLQALTVQRSTEKVAFAKLKELAY |
| ppphy3 | ----------------------ITGVICFLQIASSELQQALRVQQATEKVAIAKLKELAY |
| ppphy4 | ----------------------ITGVFCFLHTTSVELLQALTVQRATEKVAFAKLKELAY |
| psphy1 | ----------------------ITGSFCFFRIASSELQHALEVQRQQEKKCFARLKELAY |
| smphy1 | ----------------------ITGVFCFLHIASAELQQALTVQRATEKVALSKLKELAY |
| aphA | --------------------------KKFAYVASHDLQEPLNQVAN-------------- |
| cph1 | --------------------------KKFAYIASHDLQEPLNQVSN-------------- |
| cwCph1 | --------------------------KKFAYVASHDLQEPLNQVSN-------------- |
| npCph1 | --------------------------KKFAYVASHDLQEPLNQVVN-------------- |
| cwCph1a | ------------------------------------------------------------ |
| npCph1a | --------------------------ASFAYAASHDLKEPLRGIYN-------------- |
| toCphA | --------------------------KKFAYVASHDLQEPLNQVAN-------------- |
| aphB | --------------------------DAFAYIASHDLKEPLRGIHN-------------- |
| atBphP1 | --------------------------EAFSYSVSHDLRAPFRHIVG-------------- |
| atBphP3 | --------------------------EAFSYSVSHDLRAPFRHIVG-------------- |
| avAphB | --------------------------DAFAYIASHDLKEPLRGIHN-------------- |
| chBphP1 | --------------------------ENINWISTHDLQEPLRKIQI-------------- |
| chBphP2 | ------------------------------------------------------------ |
| drbphp | --------------------------RQYGFVISHHMQEPVRLISQ-------------- |
| goBphP | --------------------------DFLIREVNHRVQNSLQMVAS-------------- |
| krBphP | AEPAARTEG--------------------------------------------------- |
| mmBphP2 | ------------------------------------------------------------ |
| paBphP | --------------------------QRLIAVLGHDLRNPLQS----------------- |
| pfBphP | --------------------------DELVAVVSHDLRNPMTVISM-------------- |
| ppBphP1 | --------------------------RMLNEELNHRVKNILSLIGA-------------- |
| ppBphP2 | --------------------------EAFSYSVSHDLRAPLRHIAG-------------- |
| ppkBphP2 | --------------------------EAFSYSVSHDLRAPLRHIAG-------------- |
| psBphP1 | --------------------------DELVAVVSHDLRNPMTVISM-------------- |
| psBphP2 | --------------------------DELVAVVSHDLRNPMSIIIM-------------- |
| pssBphP1 | --------------------------DELVAVVSHDLRNPMTVISM-------------- |
| pssBphP2 | --------------------------DELVAVVSHDLRNPMSIIIM-------------- |
| pstBphP1 | --------------------------DELVAVVSHDLRNPMTVISM-------------- |
| rcPpr | --------------------------SRFLANMSHELRTPLNAIIG-------------- |
| rlBphP | --------------------------ELLIAELNHRVRNILSLITG-------------- |
| atBphP2 | --------------------------RMLNEELNHRVKNVLAIIKS-------------- |

-continued

| Name/ SEQ ID No | Sequence |
|---|---|
| brBphP | ------------------------------------------------------------ |
| rpBphP1N | ------------------------------------------------------------ |
| rpBphP2N | --------------------------ESFAHVASHDIKEPLRHIEA-------------- |
| rpBphP3N | --------------------------ESFAYVAAHDLKEPLRHIEA-------------- |
| rpBphP4N | --------------------------VLVEADLSKVLRRTVEDQEA-------------- |
| rpBphP5N | --------------------------SRYTDVASAELKEHLRGIHH-------------- |
| rpBphP6N | --------------------------RVLNEELNHRVKNILALIKS-------------- |
| rrBphP | ----------------------LEALGRLAGGIAHEIGNVLQPVLT-------------- |
| rsBphP1 | ------------------------------------------------------------ |
| rsBphP1a | ------------------------------------------------------------ |
| toCphB | --------------------------DAFAYIASHDLKEPLRGIHH-------------- |
| xaBphP | ------------------------------------------------------------ |
| xcBphP | ------------------------------------------------------------ |
| anFPH1 | --------------------------KLLLANSAHEVRTPLNAIVN-------------- |
| bfFPH2 | --------------------------RLLLKNTSHEVRTPLNAVVN-------------- |
| chFPH1 | --------------------------RLLLANSAHEVRTPLNAIIN-------------- |
| cnFPH1 | --------------------------AILLSNTSHAVRTPLSQIIN-------------- |
| gmFPH1 | --------------------------RLLLANSAHEVRTPLNAIIN-------------- |
| gzFPH1 | --------------------------RLLLANSAHEVRTPLNAIIN-------------- |
| ncFPH1 | --------------------------RLLLANSAHEVRTPLNAIIN-------------- |
| ncFPH2 | --------------------------RLLLHDASHQVRNPLNAVIN-------------- |
| umFPH1 | --------------------------RLLLSNASHEVRTPLNHIIN-------------- |
| aphC | ---------------------------QLVAGVAHEINNPVNFIYGNLSHVSEYAQNLLT |
| cph2 | ----------------------VTEVRQFLNTDRVVLFKFNSQWSGQVVTESHNDFCRSI |
| npCph2a1 | ---------------------------QLVAGVAHEINNPVNFIYGNINHVNNYAQDLLG |
| npCph2a2 | ---------------------------LLVAGVAHEINNPVNFISGNLSHLHEYTQSLIK |
| npCph2b | ---------------------------QLVAGIAHEINNPVNFIYGNLCHASDYIEQLLE |
| arphyA | IKRQIRN----------PLSGIMFTRKMMEGTELGPEQ-RQILQTSSLCQKQLSKVLDDS |
| asphya3 | MRHAINN----------PLSGMLYSRKALKNTDLNEEQ-MKQIHVGDNCHHQINKILADL |
| asphya4 | MRHAINN----------PLSGMLYSRKALKNTDLNEEQ-MKQIHVGDNCHHQINKILADL |
| atphya | IKRQIRN----------PLSGIMFTRKMIEGTELGPEQ-RRILQTSALCQKQLSKILDDS |
| cpphya | IKRQIQN----------PLSGIIFSRRLLERTELGVEQ-KELLRTSGLCQKQISKVLDES |
| cupphya | LRKQVKN----------PLSGIMFSRKMLEGTELGNDQ-QNILHTSAQCQQQLSKVLDDT |
| gmphya | MKRQIRN----------PLCGIVFSRKMLEGTDLGTEQ-KQLLRTSAQCQQQLSKILDDS |
| lephya | IRRQIRN----------PLSGIIFSRKMLEGTSLGEEQ-KNILHTSAQCQRQLNKILDDT |
| lsphya | MKRQIRN----------PLAGIVFSSKMLEGTDLETEQ-KQIVNTSSQCQRQLSKILDDS |
| mgphya | IRRQTRA----------SLSGIMYSWRLMEGTDLRERQ-KQLLHTSAQCQHQLTKILDDT |
| ntphya | IRRQIRN----------PLSGIIFSRKMLEGTNLGEEQ-KNILRTSSQCQRQLNKILDDT |
| omphya | IRREIRS----------PLSGIIFSRKLMEGTDLNDEQ-KNIVRTSLHCQSQMNKILEDT |

-continued

| Name/ SEQ ID No | Sequence |
|---|---|
| osphya | MRHAINN----------PLSGMLYSRKALKNTGLNEEQ-MKEVNVADSCHRQLNKILSDL |
| pcphya | LRRQAKN----------PLCGINFVREKLEEIGMGEEQ-TKLFRTSVHCQRHVNKILDDT |
| psphya | MKRQIRN----------PLAGIVFSSKMLEGTDLETEQ-KRIVNTSSQCQRQLSKILDDS |
| sbphya | MRHAINK----------PLSGMLYSRETLKSTGLNEEQ-MRQVHVADSCHRQLNKILADL |
| slphya1 | MKRQIKN----------PLAGIIFSGKILDGTNVDEKQ-RLVLQTSARCQGQLNKILDDS |
| slphya3 | MKRQIKN----------PLSGIMFSGKILDGTEMGEDQ-RQVLQTSIRCQGQLNKILDDS |
| slphya4 | MKRQIKN----------PLSGIMFSGKILDGTEMGEDQ-RQVLQTSIRCQGQLNKILDDS |
| stphya | IRRQIRN----------PLSGIIFSRKMLEGTSLGEEQ-KNILHTSAQCQRQLDKILDDT |
| taphya | MRHAINN----------PLSGMLYSRKALKNTDLNEEQ-MRQIHVADNCHHQLNKILADL |
| zmphya1 | MRHAIDK----------PLSGMLYSRETLKGTDLDEEQ-MRQVRVADNCHRQLNKILADL |
| atphyb | ICQVIKN----------PLSGMRFANSLLEATDLNEDQ-KQLLETSVSCEKQISRIVGDM |
| atphyd | IFQVIKN----------PLSGLRFTNSLLEDMDLNEDQ-KQLLETSVSCEKQISKIVGDM |
| gmphyb | ICQGVKK----------PLSGIRFTNSLLEATSLTNEQ-KQFLETSVACEKQMLKIIRDV |
| lephb1 | ICQEVKS----------PLNGIRFTNSLLEATNLTEYQ-KQYLETSAACERQMSKIIRDV |
| lephb2 | ICRELKN----------PLNGIRFTNSLLEATELTENQ-KQFLETSAACERQMSKIIRDI |
| npphyB | LCQEIKS----------PLNGIRFTNSLLEATDLTEDQ-KQYLETSTACERQMSKIIRDV |
| ntphyb | LCQEIKS----------PLNGIRFTNSLLEATDLTENQ-KQYLETSAACERQMSKIIRDV |
| osphyb | IYQEIKN----------PLNGIRFTNSLLEMTDLKDDQ-RQFLETSTACEKQMSKIVKDA |
| pbphyb1 | ICQEIRN----------PLSGLRFTNSLLENTDLTEDQ-KQFLETSAACEKQILKITRDV |
| pbphyb2 | ICQEIKN----------PLSGIHFTNSLLENTDLTEDQ-QQFLETSAACEKQILKIIRDI |
| sbphyB | ICQEIKN----------PLSGIRFTNSLLQMTDLNDDQ-RQFLETCSACEEQMSKIVKDA |
| slphyb | LCQEIKN----------PLNGIRFANSLLEATSLGEDQ-KQFIETSNACEKQIKKILGDI |
| stphyb1 | ICQEIKS----------PLNGIRFTNSLLEATNLTENQ-KQYLETSAACERQMSKIIRDI |
| stphyb2 | ICQEIKS----------PLNGIRFTNSLLEATNLTENQ-KQYLETSAACERQMSKIIRDI |
| zmphyb1 | ICQEIKN----------PLSGIRFTNSLLQMTDLNDDQ-RQFLETSSACEKQMSKIVKDA |
| zmphyb2 | ICQEIKN----------PLSGIRFTNSLLQMTDLNDDQ-RQFLETSSACEKQMSKIVKDA |
| atphyc | LRHEVKD----------PEKAISFLQDLLHSSGLSEDQ-KRLLRTSVLCREQLAKVISDS |
| osphyc | IRQELRN----------PLNGMQFTRNLLEPSDLTEEQ-RKLLASNVLCQEQLKKILHDT |
| sbphyc | IHQELRN----------PLNGMQFTCNLLEPSELTEEQ-RKLLSSNILCQDQLKKILHDT |
| slphyc | FREQVRS----------PIKGMAFTRNLLESSELNIEQ-KQILTTISLCESQLMKIIEDT |
| taphyc | IRQELKN----------PLNGMQFTRKLLEPSDLTEEQ-RQLFASNVLCQEQLKKILHDN |
| zmphyc1 | IRQELRN----------PLNGMQFTCNLLKPSELTEEQ-RQLLSSNVLCQDQLKKILHDT |
| zmphyc2 | IRQELRN----------PLNGMQFTYNLLKPSELTEDQ-RQLVSSNVLCQDQLKKILHDT |
| lephye | VLQQMKN----------PLNGIQFTHKLLEATGVSDNQ-KQLLETSEACEKQILSVIDNM |
| atphye | VRQEIKN----------PLNGIRFAHKLLESSEISASQ-RQFLETSDACEKQITTIIEST |
| inphye | IQQQMKN----------PLNGIRFTHKLLEGTVTSDHQ-KQFLETSEACEKQILSIIENM |
| lephyf | VRLELKN----------PLNGINCIQNLLKSSDLSKDQ-RQLLKTSTMCQKQLAKIIDDT |
| acvphy1 | VKEELKK----------PLEGLAFTRTVLEGTNLTIEQ-RQLIKTNAWCERQLRKILED- |

-continued

| Name/ SEQ ID No | Sequence |
|---|---|
| acvphy2 | MKQEIRN----------PLYGIVFTRKLLDNTNLTDEQ-KQIMETSSLCEKQLQNILDED |
| acvphy3 | M----------------DHPFLPTLYASFQTKT------HVCLITDYCPGGDLFLLQDKQ |
| apphy1 | MKQEIRN----------PLYGIIFTRKLMESSNLTAEQ-KQLIETSAVCERQLQKILDED |
| cpphy2 | IRQEIKN----------PLCGITFTRQLLEDTDLSDDQ-KQFLDTSAVCEQQLQKVLNDM |
| mcphy1 | IRQEIQN----------PLDGIHFARSFIEHTELSEDQ-KQLMETSATCEKQLRRILDDM |
| mpphy1 | IRQEIKN----------PLYGIMFTRNLVEDTNLTEEQ-KQFIETSALCERQLRRILDDM |
| msphy1 | IRQEIQN----------PLDGIHFARSFMEHTVLSEDQ-KQLIETSATCEKQLRRILADM |
| paphy1 | IRQEIRN----------PLYGIIFTRKLMESTDLSEEQ-KQIVQTSALCQRQLVKVLDDA |
| ppphy0 | IVREIKN----------PLCGLTFTRQLLEDTDLSDDQ-QQFLDTSAVCEQQLQKSLNDM |
| ppphy1 | IRQEIKN----------PLCGITFTRQLLEDTDLSDDQ-QQFLDTSAVCEQQLQKVLNDM |
| ppphy2 | IRQEIKN----------PLYGIVFTRNLMEDTDLSVDQ-RQLVETSAVCERQLRKILDDL |
| ppphy3 | IRQEIKN----------PLCGITFTRQLLEDTDLSNDQ-KQFLDTSAVCEQQLQKVLNDL |
| ppphy4 | IRQEIKN----------PLYGIMFTRNLMEDTDLSEDQ-RQFVETSAVCERQLRKVLDDM |
| psphy1 | IRQEIKN----------PLYGMMFTRKLLEETDLSDDQ-KQFVETSAVCERQMQKVMDDM |
| smphy1 | IRQEIKN----------PLYGIMFTRTLMETTDLSEDQ-KQYVETGAVCEKQIRKILDDM |
| aphA | ------------------YVQLLEMRYQDQLDADANE---FITFAVEGVSLMQTLIDDVL |
| cph1 | ------------------YVQLLEMRYSEALDEDAKD---FIDFAVTGVSLMQTLIDDIL |
| cwCph1 | ------------------YVQLLEMRYDEALDEDGKE---FINFAVEGVSLMQTLIDDVL |
| npCph1 | ------------------YVQLLEMRYSEELDEDAQE---FISYAVQGVSLMQTLIDDVL |
| cwCph1a | ------------------------------------------------------------ |
| npCph1a | ------------------FSTVLLEDYAQVLDDDGIE---CLQTVVSLSVRMETLINALL |
| toCphA | ------------------YVQLLEMRYENELDEDAKE---FINFAVEGVSLMQTLIDDVL |
| aphB | --------------------YSNFLMEDYGEIIDAPGK-EKLLTLIRLTQRMEDLIDSLL |
| atBphP1 | ------------------FAQLLRER-SDALDEKSLH---YLQMISEAALGAGRLVDDLL |
| atBphP3 | ------------------FAQLLRER-SDALDEKSLH---YLQMISEAALGAGRLVDDLL |
| avAphB | ------------------YSNFLMEDYGEIIDAQGKE---KLLTLIRLTQRMEDLIDSLL |
| chBphP1 | ---------------------ITSYVLSVENTLSEASYE-KLQKINKSANRMQALISDIL |
| chBphP2 | ------------------------------------------------------------ |
| drbphp | ------------------FAELLTRQPRAQDGSPDSPQTERITGFLLRETSRLRSLTQDL |
| goBphP | ---------------------FLKLQARSASNEETTTALTEAQHRIAAIGLVHRRLYRDE |
| krBphP | ------------------------------------------------------------ |
| mmBphP2 | ------------------------------------------------------------ |
| paBphP | -------------------ISMAAALLSSSDTRTTELR----QHISASSSRMERLVSQIL |
| pfBphP | ------------------LCGMMQKAFSSDGPHTSRRISTAIDTMQQAAGRMNTLLEDLL |
| ppBphP1 | ---------------------LVAHPTPESQTLQD------------------YVATLKG |
| ppBphP2 | ------------------YTELLGEIEGQGLSERGKR---FLQHIGEAAHFAGSLVDNLL |
| ppkBphP2 | ------------------YTELLGEIEGQGLSERGKR---FLQHIGEAAHFAGSLVDNLL |
| psBphP1 | ------------------LCGMMQKSFSSDGPHTSRRIS-RQSTHAASCQPHERVARDLL |
| psBphP2 | ------------------QCGMMQRWAVDDTNFENRNIRRALGTIEKATTRMNSLLEDLL |

-continued

| Name/ SEQ ID No | Sequence |
|---|---|
| pssBphP1 | ------------------LCGMMQKSFSSDGPHTSRRISTAIDTMQQAASRMNVLLEDLL |
| pssBphP2 | ------------------QCGMMQSWAVGDTHFENRNIRRALGTIEKATTRMNSLLEDLL |
| pstBphP1 | ------------------LCGMMQKSFSSDGPHTSRRISTAIDTMQQAASRMNVLLEDLL |
| rcPpr | -----------------FSDLMMSGMAGTLPPRIQD---YVQSIHASGEHLLRMVVNDVL |
| rlBphP | ---------------------IIRQSQATSVSLGD------------------YIRQLEG |
| atBphP2 | ---------------------LVGNPSQEGKTLQE------------------YVTALKG |
| brBphP | ------------------------------------------------------------ |
| rpBphP1N | ------------------------------------------------------------ |
| rpBphP2N | -------------------FAGLLADNIREMGDERLGV--MVSGIEKSSRRLRNLINDLA |
| rpBphP3N | -------------------FAGLLNDLLLPEARSRLSL--MVNGIEASSRRLRALINDLA |
| rpBphP4N | -------------------ERLRIARELHDTLGQS---------LTLLQLGFDKLGQAAG |
| rpBphP5N | ---------------------LTTSLRRRQGEVLDEEGRQ-QVATILKLTQRMDALVDAL |
| rpBphP6N | ---------------------LVNQPAGEGKSLEE------------------FASALRG |
| rrBphP | -------------------MAHYASKRLDDRDFLEA-------ALADICEGGARAKDIVR |
| rsBphP1 | ------------------------------------------------------------ |
| rsBphP1a | ------------------------------------------------------------ |
| toCphB | ------------------YSSFLIEDYGNRLDDEGIG---RLRTLIRLTQRMENLIDSLL |
| xaBphP | ------------------------------------------------------------ |
| xcBphP | ------------------------------------------------------------ |
| anFPH1 | ------------------YLEIALEGALDGETR------DHLSKSYSASKSLIYVINDLL |
| bfFPH2 | ------------------YLEMALEDKIESPTR------ELLEKAHRASRSLVYVIDDLL |
| chFPH1 | ------------------YLEIALEGALDQETR------ENLSRSHSASKSLIYVINDLL |
| cnFPH1 | ------------------TLELALAGNIDDDVR------KMLENSHQASRALLFHVHDLL |
| gmFPH1 | ------------------YLEIALEGSLDQETR------ENLARSHSASKSLIYVINDLL |
| gzFPH1 | ------------------YLEIALEGSLDQETR------DNLARSHSASKSLIYVINDLL |
| ncFPH1 | ------------------YLEIALEGSLDQETR------DNLARSHSASKSLIYVINDLL |
| ncFPH2 | ------------------CLEIALEKHLDDGTK------QVLTTSYTASKSLIYVIDDLL |
| umFPH1 | ------------------YLELALDSKLDEDTR------ENLSKSHLASKSLLFVINDLL |
| aphC | MLELYQQEL------PNPSVEILEQADEIDLEFLAKDLPKTLSSMQIGVERIRQIVMSLR |
| cph2 | INDEIDDPCFKGHYLRLYREGRVRAVSDIEKADLADCHKELLRHYQVKANLVVPVVFNEN |
| npCph2a1 | ILDLYLQNT------PNPSPEIRDRTFEIDLEFLIEDLPKTLSSMKIGVDRIRQIVLGLR |
| npCph2a2 | MLNIYQQIY------PQPHPEIEKQAILSDLEFIAEDLPKLFSSLKIGAERIGEIVLSLR |
| npCph2b | ILRLYQLHY------PDPHSEISAAIEAVDFEFLVEDLPRIITSMQVGSDRIRSIVLSLR |
| arphyA | DLERIIEGC--LDLEMKEFSLNEVLTASTSQVMMKSN----GKSVRITN------ETGEE |
| asphya3 | DQDSITEKSSCLDLEMAEFLLQDVVVAAVSQVLITCQ----GKGIRISC------NLPER |
| asphya4 | DQDSISEKSSCLDLEMAEFVFQDVVVAAVSQVLITCQ----GKGIRISC------NLPER |
| atphya | DLESIIEG--CLDLEMKEFTLNEVLTASTSQVMMKSN----GKSVRITN------ETGEE |
| cpphya | DIDKIIDG--FIDLEMDEFTLHEVLMVSISQVMLKIK----GKGIQIVNE------TPEE |

-continued

| Name/ SEQ ID No | Sequence |
|---|---|
| cupphya | DLDCIIEG--YLDLEMVEFKLDEVLLASISQVMTKSN----GKSLRVIND------VAEN |
| gmphya | DLDTIIDG--YLDLEMAEFTLHEVLVTSLSQVMEKSN----GKSIRIVND------VAGH |
| lephya | DLDSIIDG--YLDLEMLEFKLHEVLVASISQVMMKSN----GKNIMISND------MVED |
| lsphya | DLDGIIDG--YLDLEMAEFTLHEVLVTSLSQVMNRSN----TKGIRIAND------VAEH |
| mgphya | DLDCIIDG--YLDLEMVEFTLYEVLSASISQVTLKSN----GKGIHIANP------LQEE |
| ntphya | DLDSIIDG--YLDLEMLEFKLHEVLVASISQIMMKSN----GKNIMIVND------MVED |
| omphya | DLDHIIEG--YLDLEMVEFKLHEVLIASISQVISKSN----GKGIKIVDN------LAPN |
| osphya | DQDSVMNKSSCLDLEMVEFVLQDVFVAAVSQVLITCQ----GKGIRVSCN------LPER |
| pcphya | DLDSIIDG--YLDLEMSEFRLHDVYVASRSQVSMRSN----GKAIQVVDN------FSEE |
| psphya | DLDGIIDG--YLDLEMAEFTLHEVLVTSLSQVMNRSN----TKGIRIAND------VAEH |
| sbphya | DQDNITDKSSCLDLDMAEFVLEDVVVSAVSQVLIGCQ----GKGIRVACN------LPER |
| slphya1 | DLDSIIDG--YCELEMVEFAVQDILVASISQVMAKSS----EKGIQMSNN------CTEH |
| slphya3 | DLDSIIDG--YCELEMVEFTVQDILVASTCQVMAKSN----EKGIQIANDS-----TTEH |
| slphya4 | DLDSIIDG--YCELEMVEFTVQDILVASISQVMAKSS----EKGIQMSNN------CTEH |
| stphya | DLDSIIEG--YLDLEMLEFKLHEVLVASISQVMMKSN----GKNIMISND------MVED |
| taphya | DQHNIMEKSSCLDLEMAEFVLQDVVVAAVSQVLIACQ----GKGIRVSCN------LPER |
| zmphya1 | DQDNITDKSSCLDLDMAEFVLQDVVVSAVSQVLIGCQ----GKGIRVACN------LPER |
| atphyb | DLESIEDG--SFVLKREEFFLGSVINAIVSQAMFLLR----DRGLQLIR------DIPEE |
| atphyd | DVKSIDDG--SFLLERTEFFIGNVTNAVVSQVMLVVR----ERNLQLIR------NIPTE |
| gmphyb | DLESIEDG--SLELEKGEFLLGNVINAVVSQVILLLR----ERNLQLIRD------IPEE |
| lephb1 | DLENIEDG--SLTLEKEDFFLGSVIDAVVSQVMLLLR----EKGVQLIRD------IPEE |
| lephb2 | DLDNIEDG--SLELEKGEFFLASVIDAVVSQVMLLLR----ERGVQLIRD------IPDE |
| npphyB | DLENIEDG--SLTLDKEEFFLGSVIDAVVSQVMLLLR----ERSVQLIRD------IPEE |
| ntphyb | DLENIEDG--SLTLEKEEFFLGSVIDAVVSQVMLLLR----ERSVQLIRD------IPEE |
| osphyb | SLQSIEDG--SLVLEKGEFSLGSVMNAVVSQVMIQLR----ERDLQLIRD------IPDE |
| pbphyb1 | DLESIENG--LLELEKAEFLFGSVINAVVSQAMLLLR----ERNLQLLRD------IPEE |
| pbphyb2 | DLESIENG--SLELEKAEFLLGSVINAVVSQAMLLLR----ERNLQLLRD------IPEE |
| sbphyB | TLQSIEDG--SLVLEKSEFSFGDVMNAVVSQAMLLLR----ERDLQLIRD------IPDE |
| slphyb | HLESVDES--PFELVKTEFMLGNIINAVVSQVMIPLR----ERELQLIRD------IPEE |
| stphyb1 | DLENIEDG--SLTLEKEDFFLGSVIDAVVSQVMLLLR----EKGVQLIRD------IPEE |
| stphyb2 | DLENIEDG--SLTLEKEDFFLGSVIDAVVSQVMLLLR----EKGVQLIRD------IPEE |
| zmphyb1 | SLQSIEDG--SLVLEQSEFSLGDVMNAVVSQAMLLLR----ERDLQLIRD------IPDE |
| zmphyb2 | SLKSIEDG--SLVLEKSEFSLGDVMNAVVSQTMSLLR----ERDLQLIRD------IPDE |
| atphyc | DIEGIEEG--YVELDCSEFGLQESLEAVVKQVMELSI----ERKVQISC------DYPQE |
| osphyc | DLESIEQC--YTEMSTVDFNLEEALNTVLMQAMPQSK----EKQISIDRD------WPAE |
| sbphyc | DLESIEQC--YMEMNTVEFNLEEALNTVLMQGIPLGK----EKRISIERD------WPVE |
| slphyc | DIPSIEEG--YLETSSDDFNLLEALDAVVSQVMPLSQ----ESQVHIKHD------FPSD |
| taphyc | DLEGIEQC--YMEMNTVEFNLEEALNTVLMQGMSVSK----EKQISLDRD------WPVE |
| zmphyc1 | DLESIEQC--YMEMNTVEFNLEQALNTVLMQGIPLGK----EKQISIERN------WPVE |

-continued

| Name/ SEQ ID No | Sequence |
|---|---|
| zmphyc2 | DLESIEQC--YMETNTVEFNLEEALNTVLMQGIPLGK----EKRISIERD------WPVE |
| lephye | DFGGIEDG--KVQLNMEEFVLGNVVDAIVSQVMIFLK----EKNLQLLHD------IPDQ |
| atphye | DLKSIEEG--KLQLETEEFRLENILDTIISQVMIILR----ERNSQLRV------EVAEE |
| inphye | DSGGIVDG-NRVELKTEEFVIGNVIDAVVSQVMIPLK----EKNLQLLHD------IPDQ |
| lephyf | DIESIEEC--YTEMNSCEFNLGEVVTVVINQVMILSQ----ERKVQVTWD------SPVE |
| acvphy1 | DLNNIEEG--YMDLEMSEFFMGSVIDAVISQGMAASR----GKGVQILTD------IPND |
| acvphy2 | NFEKLDQG--NVDLDTLEFTMGTVMDAVISQGMIRSR----EKGLQLIRE------THVE |
| acvphy3 | PTQTLSERTASFYAAEVVVALEYLHCMGVIYRDLKPENVLLQKNGHILLTDFDLSFLTSC |
| apphy1 | NFEKLDQGN--IDLETVEFSMGTVMDAVISQGMIRSR----EKGLQLVR------ETNIE |
| cpphy2 | DLESIEDG--YLELDTAEFEMGTVMDAVISQGMTTSR----EKGLQIIRE------TPRE |
| mcphy1 | DLESIEEG--YLELETGEFMMATVMNSVVSQGMVQSS----KKGLQLFCD------TPPE |
| mpphy1 | DLESIEDG--YLELDTAEFIMGTVMDAVISQGMITSR----EKGLQLIWD------TPRD |
| msphy1 | DLASIEKG--YLELETGEFSMATVMNSVVSQGMIQST----QKNLQLYCD------TPPD |
| paphy1 | DLESIEDG--YLELDTIEFTLGTVLDAVVSQGMILSR----EKGLQLIRD------SPEE |
| ppphy0 | DLESIEDG--YLELDTAEFEMGTVMNAVISQGMTTSR----EKGLQIFRE------TPRE |
| ppphy1 | DLESIEDG--YLELDTAEFEMGTVMNAVISQGMTTSR----EKGLQIFRE------TPRE |
| ppphy2 | DLESIEDG--YLELDTTEFEMGTVMDAVVSQGMITSR----EKGLQLIRE------TPSE |
| ppphy3 | DLESIEDG--YLELDTAEFEMRTVMDAVISQGMTISR----EKGLQIIRE------TPRE |
| ppphy4 | DLESIEDG--YLELDTNEFVMGTVMDAVVSQGMITSR----EKGLQLIRE------TPRE |
| psphy1 | DLESLEDG--YMELDTAEFILGTVIDAVVSQGMIVLR----EKGLQLIRE------IPGE |
| smphy1 | DLESIEDG--YLELDTTEFMMGTVMDAVISQGMITSK----EKNLQLIRE------TPKE |
| aphA | AYSKVDTQ----AIAFQLTEVEKALDKALGNLRQRIA----ETGANITH---------- |
| cph1 | TYAKVDTQ----YAQLTFTDVQEVVDKALANLKQRIE----ESGAEIEV---------- |
| cwCph1 | AYSKVDIR-----DIKFDLTESENALEKAIANLRGRI----AETNAIIT---------H |
| npCph1 | AYSKVDMQ----AIAFQMNDVETALMRGLGNLRQRIN----ETGATI----------TH |
| cwCph1a | ------------------------------------------------------------ |
| npCph1a | RLSQLGQA----HLREQATDLNELLNQVIDVFRASRQ----DSGLVD---------IRIP |
| toCphA | AYSKVDMQ----ASAFQLTEVETPLNRSLSNLRGRIH----ETGAMITH---------- |
| aphB | HFSRLGRV----DLSMQDTDLNEIVHRILDMLSGRIE----ETGVEIRI---------L |
| atBphP1 | NFSQLGRT----QLTLKPVDMQKVVSEVRRSLSHAVS----DRQIEWRI---------- |
| atBphP3 | NFSQLGRT----QLTLKPVDMQKVVSEVRRSLSHAVS----DRQIEWRI---------- |
| avAphB | HFSRLGRV----DLSMQDTDLNEIVHRILDMLSGRIE----ETGVEIRI---------V |
| chBphP1 | RYTKLKAS----TEILESVDLKNIVTEVIQEVDDALE----AKKANIYI---------- |
| chBphP2 | ------------------------------------------------------------ |
| drbphp | HTYTALLS--APPPVRRPTPLGRVVDDVLQDLEPRIA----DTGASIEV---------A |
| goBphP | HFGIVDLG-----------------RYLEELMEELCS----SLGGDWQEQL-----HLSL |
| krBphP | ------------------------------------------------------------ |
| mmBphP2 | ------------------------------------------------------------ |

-continued

| Name/SEQ ID No | Sequence |
|---|---|
| paBphP | DMSRLQSG-IGLTVNPVDTDVSQLVRQIVCETDVAYP----GLVIEIAID---------- |
| pfBphP | DTSKIDAG--RYTIAPQKLDVAQMFEEAQSLLAPLAL----DKDISISFE---------A |
| ppBphP1 | RIQALSLA--HDQVVRGDGGGRLAKLLEAELSPYRTA----ADVIEL-----------QG |
| ppBphP2 | NFSQMGRS----ALRLSDVDLNALVEAIRSELAPDYE----GRAIVW-----------DI |
| ppkBphP2 | NFSQMGRS----ALRLSDVDLNALVEAIRSELAPDYE----GRAIVW-----------DI |
| psBphP1 | DTSKIEAG--RTPSRRSRWKSARYSKRPIRCSPRWRM----DKSIEISFN---------A |
| psBphP2 | DTAQIEAG--RYQLSRLALSVTSLLEEACSLLVMLTT----EKNIELNCT---------S |
| pssBphP1 | DTSKIEAG--RYTITPQPLEVSQIFEEAYTLLAPLAM----DKSIEISFN---------A |
| pssBphP2 | DTAQIEAG--RYQLSRLPLSVTSLLEEACSLLVMLTT----EKNIELNCT---------A |
| pstBphP1 | DTSKIEAG--RYTITPQPLEVSQIFEEAYTLLAPLAM----DKSIEISFN---------A |
| rcPpr | DLSRIEAG--RMELSPESLDAGILAAECVGMLLPRAV----RGEVLLEVQ---------A |
| rlBphP | RIQSLARA--HDQITRDHWAPASLRQLLLAETAAYLG----KNAQRIQMG---------G |
| atBphP2 | RIQALSFA--HDQIIRGEGGGALRDLLEAELSPHRSP----ETTVKLEG----------- |
| brBphP | ------------------------------------------------------------ |
| rpBphP1N | ------------------------------------------------------------ |
| rpBphP2N | EFSQLGRR----SKPLSWVSLETVLNEVLADLQPRIT----EARAEIQ----------A |
| rpBphP3N | EYSRIGRQ----ARPLQPVDLNQILTEVLSDLKPMLQ----DARAEVV----------S |
| rpBphP4N | DNPELQ-------QRIAEMKSLTADVGRQANRLAWEI----RPTALDDLGI-----QTAI |
| rpBphP5N | LDRSRGGS----EAASETVDLEAVVDDALAPFARRIA----EDRIEVR---------RP |
| rpBphP6N | RIMALSFA--HDQVVRSDGG--GALLDLIQAELSPYP----ASQITLE----------G |
| rrBphP | SVLTFA-------RQTPAERRPLVLAPALARSVAFAA----KGHPGLEII------TDIP |
| rsBphP1 | ------------------------------------------------------------ |
| rsBphP1a | ------------------------------------------------------------ |
| toCphB | HFSRLGRV----ELGIQPTDLNDLVQRVIDVLSARIQ----ETGATIRIP---------- |
| xaBphP | ------------------------------------------------------------ |
| xcBphP | ------------------------------------------------------------ |
| anFPH1 | DLTNVEKGQ--SLIKDEPFDLPTTFSEATAMFESEAK----RKGLNYKV-------LSQP |
| bfFPH2 | KLTKAETG--PVTSVKDVFDLSATVSEVMSAFQKEAV----RKNLDLTV-------TIQQ |
| chFPH1 | DLTKTEEG--GPLIKGELFDLKDTIREATDMFRNDAK----RKNIEYQI-------IQHP |
| cnFPH1 | DLTRIETG--NETAFNDPFDIRQSISDAVRLYQTEVA----RRGLEFRV-------NMAE |
| gmFPH1 | DLTKTEEG--QNLVKDEVFDLASCIREATGPFLNDAK----RKGIHYTV-------VQHP |
| gzFPH1 | DLTKTEEG--QNLVKDEVFDLASCIREATGPFLNDAK----RKGIHYTI-------VQHP |
| ncFPH1 | DLTKTEEGK--DLVKDEVFDLLACIREATEPFRHDAK----RKGITYEV-------IEHP |
| ncFPH2 | SLTGSITG--SVPLLDEPFHLPNCLEEVLCPLRRLGQ----EKGIQLIM-------IPST |
| umFPH1 | DLTKQEIGNE--LFLQEPFDLAATVREAVEMHEWEAK----RRKIDFSVTT--------N |
| aphC | TFSRLDEA----EMKAVNIHEGIDSTLLILQHRLKAK----PETAGIKL-------TKKY |
| cph2 | LWGLLIAHECKTPRYWQEEDLQLLMELATQVAIAIHQ----GELYEQLETANIRLQQISS |
| npCph2a1 | NFSRLDEA------EMKPVDIHEGIDSTLLILQHRLK----AKPESPAIKL-----VKEY |
| npCph2a2 | NFSRLDQA------QVKPVDIHEGLDSTLLILQHRLK----ANSLHLGIEI-----VKQY |

-continued

| Name/ SEQ ID No | Sequence |
|---|---|
| npCph2b | NFSRLDEA------ENKRVDLHEGIDNTLLILQHQLK----GNGKFPGIQV-----IKDY |
| arphyA | VMSDTLYGDSIRLQQVLADFMLMSVNFTPS-----GGQLTVTASLRKDQLGRSV------ |
| asphya3 | FMKQSVYGDGVRLQQILSDFLFISVKFSPV-----GGSVEISSKLTKNSIGENL------ |
| asphya4 | FMKQSVYGDGVRLQQILSDFLFISVKFSPV-----GGSVEISSKLTKNSIGENL------ |
| atphya | VMSDTLYGDSIRLQQVLADFMLMAVNFTPS-----GGQLTVSASLRKDQLGRSV------ |
| cpphya | AMSETLYGDSLRLQQVLADFLLISVSYAPS-----GGQLTISTDVTKNQLGKSV------ |
| cupphya | VLCETLYGDSLRLQQVLAEFLSVAVNFTPS-----GGQLAVSSSLTKDHLGQSV------ |
| gmphya | IMMETLYGDSLRLQQVLADFLLISINFTPN-----GGQVVVAGSLTKEQLGKSV------ |
| lephya | LLNETLYGDSPRLQQVLANFLLVSVNATPS-----GGQLSISGRLTKDRIGESV------ |
| lsphya | IAKESLYGDSLRLQQVLADFLLISINSTPN-----GGQVVIASSLTKEQLGKSV------ |
| mgphya | KMPATLYGDNLRLQQVIADFLSISVNFTPN-----GGQIVASASLTKDRLGQSV------ |
| ntphya | LLNETLYGDSPRLQQVLANFLLVCVNSTPS-----GGQLSISGTLTKDRIGESV------ |
| omphya | LSNETLYGDSLRLQQVLAAFLLIAVDSTPS-----GGQLGVAATLAKDSIGEFV------ |
| osphya | YMKQTVYGDGVRLQQILSDFLFVSVKFSPV-----GGSVEISCSLTKNSIGENL------ |
| pcphya | MMSETLYGDSLRLQKVLADFMSVCVNLTPV-----GGHLGISVTLTEDNLGQSV------ |
| psphya | IARETLYGDSLRLQQVLADFLLISINSTPNGG-----QVVIAASLTKEQLGKSV------ |
| sbphya | FMKQKVYGDGIRLQQILSDFLFVSVKFSPV-----GGSVDISSKLTKNSIGENL------ |
| slphya1 | GFKETLYGDSLRLQQILADFLSISVNFTSP-----GGHIGVTVRLTKDKIGESV------ |
| slphya3 | GLKETLYGDSLRLQQILADFLWISVNFTPA-----GGNVGIKVRLTKDKIGESI------ |
| slphya4 | GFKETLYGDSLRLQQILADFLSISVNFTSP-----GGHIGVTVRLTKDKIGESV------ |
| stphya | LLNETLYGDSPRLQQVLANFLLVSVNSTPS-----GGKLSISGKLTKDRIGESV------ |
| taphya | FMKQLVYGDGVRLQQILSDFLSISVKFSPV-----GSSVEISAKATKNSIGENL------ |
| zmphya1 | SMKQKVYGDGIRLQQILSDFLFVSVKFSPA-----GGSVDISSKLTKNSIGENL------ |
| atphyb | IKSIEVFGDQIRIQQLLAEFLLSIIRYAPS-Q----EWVEIHLSQLSKQMADGF------ |
| atphyd | VKSMAVYGDQIRLQQVLAEFLLSIVRYAPM-E----GSVELHLCPTLNQMADGF------ |
| gmphyb | IKTLAVYGDQLRIQQVLSDFLLNIVRYAPSPD----GWVEIHVRPRIKQISDGL------ |
| lephb1 | IKTLTVHGDQVRIQQVLADFLLNMVRYAPSPD----GWVEIQLRPSMMPISDGA------ |
| lephb2 | IKTLRVYGDQVRIQQVFADFLQIMASYAPPRE----GWVEVHLRPSIKQISDGV------ |
| npphyB | IKTLTVHGDQVRIQQVLADFLLNMVRYAPSPD----GWVEIQLQPNMKQISDEV------ |
| ntphyb | IKTLTVHGDQVRIQQVLADFLLNMVRYAPSPD----GWVEIQLQPNMKQISDEV------ |
| osphyb | IKEASAYGDQYRIQQVLCDFLLSMVRFAPAEN----GWVEIQVRPNIKQNSDGT------ |
| pbphyb1 | IKTLVVYGDQARIQQVLADFLLNMVRYAPSSA----GWVEIHVCPTLKQISDGH------ |
| pbphyb2 | IKTLAVYGDQARIQQVLADFLLNMVRYAPSSA----GWVEIHVCPTLKQISDGH------ |
| sbphyB | IKDASAYGDQFRIQQVLADFLLSMVRSAPSEN----GWVEIQVRPNVKQNSDGT------ |
| slphyb | IKTLAVCGDQIRIQQILAEFLVNMVRYAPSPD----GWVEIHVLPRLKQVADGA------ |
| stphyb1 | IKTLTVHGDQVRIQQVLADFLLNMVRYAPSPD----GWVEIQLRPSMMPISDGV------ |
| stphyb2 | IKTLTVHGDQVRIQQVLADFLLNMVRYAPSPD----GWVEIQLRPSMMPISDGV------ |
| zmphyb1 | IKDASAYGDQCRIQQVLADFLLSMVRSAPSEN----GWVEIQVRPNVKQNSDGT------ |

| Name/SEQ ID No | Sequence |
|---|---|
| zmphyb2 | IKDASAYGDQFRIQQVLADFLLSMAQSAPSEN----GWVEIQVRPNVKQNYDGT------ |
| atphyc | VSSMRLYGDNLRLQQILSETLLSSIRFTPALR---GLCVSFKVIARIEAIGKRM------ |
| osphyc | VSCMHLCGDNLRLQQVLADFLACTLQFTQPA----EGPIVLQVIPRMENIGSGM------ |
| sbphyc | ISRMYLYGDNLRLQQVLADYLACALQFTQPA----EGPIVLQVIPKKENIGSGM------ |
| slphyc | LSPVCLFGDNVRLQQILSNFLTIAVRFTPPST---GSSVKFAVSSRTEHVGSKM------ |
| taphyc | VSSMYLYGDNLRLQQVLADYLACTLQFTRPA----EGPIVLQVIPKKEHIGSGM------ |
| zmphyc1 | VSCMYLYGDNLRLQQILADYLACALQFTQTA----EGPIVLQVMSKKENIGSGM------ |
| zmphyc2 | VSHMYIYGDNIRLQQVLADYLACALQFTQPA----EGHIVLQVIPKKENIGSGM------ |
| lephye | IKTLPLYGDQIKLQRVLSDFLLSVVHHAPSPD----GWVEIKVLPGLKLIQDGN------ |
| atphye | IKTLPLNGDRVKLQLILADLLRNIVNHAPFPN----SWVGISISPGQELSRDNG------ |
| inphye | IKSLPIYGDQIKLQLVLSDFLLSIVRHAPSPD----GWVEIRVSPGLKLIQDGN------ |
| lephyf | VSQLYLIGDNLRLQQVLSDFLTTAILFTPFE----DSSVHFRVIPRKERIGTKM------ |
| acvphy1 | VKLMCDFGDQARLQQVLADLLFCAINHATTTNEDEKDWVTIKVSRTKTRLDDGV------ |
| acvphy2 | IKNTRLFGDQYRLQQVLADFLTTAIRFTSSSD----GWVGIKVVPTIKNMKDGL------ |
| acvphy3 | RPQLILQGGKGRSRRSKRRRRVTFCAEPRVSSNSFVGTEEYIAPEIISGEPHSS------ |
| apphy1 | LKNTPVFGDQLRLQQVLADFLTTAVRFTSSSD----GWVGIKVVSSIKSIGDGF------ |
| cpphy2 | ISTMRLFGDQIRLQQVLSDFLINAIRFTPSSE----GWVKIKVVPTRKRLGGNV------ |
| mcphy1 | FKSMCVFGDQVRLQQVLADFLMNAVQFTPAS-----GWVEIKVVPNVRSLPGGI------ |
| mpphy1 | TKNLCLFGDQVRLQQVLADFLLNAIRFTPSSE----GWVGIKGVSSRHRQGGGV------ |
| msphy1 | FKSLSVFGDQVRLQQVLADFLLNAVQFTPPS-----GWVEIKVEPVVKKLPGGV------ |
| paphy1 | IKTMCLYGDQLRLQQILSNFLINALRFS-TSE----GWVGNKVVPTKRHLGSGV------ |
| ppphy0 | INTMRLLGDQIRLQQVLSDFLLNTVRFTPSPE----GWVKIKVVPTRKRLGGSV------ |
| ppphy1 | INTMRLLGDQIRLQQVLSDFLLNTVRFTPSPE----GWVKIKVVPTRKRLGGSV------ |
| ppphy2 | IKNMCLYGDQVRLQQVLADFLLNAVRFTPSSE----GWVGIKVVPTKKRLGRGV------ |
| ppphy3 | IITMRLFGDQVRLQQVLSDFLLNAVRFTPSSE----GWVKIKVVPTRKRLGGNE------ |
| ppphy4 | IKNMCLFGDQVRLQQVLADFLLNAVKFTPSSG----GWVGIKVVPTKKRLGGGI------ |
| psphy1 | VKTMRLYGDEVKIQQILADFLLNVLRFTPSPE----GWVAIKVFPTLKQLGGGL------ |
| smphy1 | IKAMFLYGDQVRLQQVLADFLLNAIRFTPSSE----NWVGIKVATSRKRLGGVV------ |
| aphA | DPLPTVMAGSTQLMQLFQNLIANAIKFRS-EE---APQIHIGAERLED------------ |
| cph1 | GSMPAVMADQIQLMQVFQNLIANGIKFAG-DK---SPKIKIWGDRQED------------ |
| cwCph1 | DPLPTVMANSTQLIQLFLNLISNAIKFRS-EA---TPEIHIQAQRLED------------ |
| npCph1 | DPLPTVMADSTQLMQLFQNLIGNAIKFHS-DQ---PPQIHVGAERIED------------ |
| cwCph1a | ------------------------------------------------------------ |
| npCph1a | RPLPTIQCDRVLVNEVFSNLLGNAFKYND-KA---EQWVEIGYLSQEEGQGVGSRGQGAG |
| toCphA | DPLPTVMADSTQLMQLFQNLIANAIKFRS-EQ---PPKIHIGAERLED------------ |
| aphB | QLLPVVYCDRIQIGEVFSNLIANSIKYND-KA---NKWIEIGYIDNP------------- |
| atBphP1 | GALPVIFGDPTLLRQVWYNLIENAIKYSSREP---VSIITISAVETED------------ |
| atBphP3 | GALPVIFGDPTLLRQVWYNLIENAIKYSSREP---VSIITISAVETED------------ |
| avAphB | QLLPVVYCDRIQIGEVFSNLIANSIKYND-KA---NKWIEIGYIDNQ------------- |

-continued

| Name/ SEQ ID No | Sequence |
|---|---|
| chBphP1 | SDLPEMSGIPFLLAQLFLNLISNSLKFADATR---VLSIHIVQEGIIVKEEQE------- |
| chBphP2 | ----------------------------------------------------------- |
| drbphp | PELPVIAADAGLLRDLLLHLIGNALTFGGPEP-----RIAVRTERQGA----------- |
| goBphP | FPIMISADRAINIGLVLTELVINASKYAYDGK---AGPLHVGLAQTSDRLVLTVS----- |
| krBphP | ----------------------------------------------------------- |
| mmBphP2 | ----------------------------------------------------------- |
| paBphP | -PQVRAVVDPDRYAQVAANLLSNARHHGLPGR-----PVLVTLTRQGD----------- |
| pfBphP | DPDLSIHADPERLFQVLSNLVGNAIKFTPRLG---TVDVYAKSVGDD------------ |
| ppBphP1 | PNVILDARAYSVMALVLHELATNAAKYGALSRA--GGKLSVSWAIDASNACA-------- |
| ppBphP2 | APLPKVIGDPAFINMALHNLIANAIKYTRGRT---PARIEISAVQHPE----------- |
| ppkBphP2 | APLPKVIGDPAFINMALHNLIANAIKYTRGRT---PARIEISAVQHPE----------- |
| psBphP1 | EPDIKVNADPERLFQVLSNLIGNAIKFTPKLG---RIGVAAMSNGDE------------ |
| psBphP2 | AQGLVIDADPERIFQVLSNLVGNAIKFTPKGG---RINIDAVADGDD------------ |
| pssBphP1 | EPDLKVQADPERLFQVLSNLIGNAIKFTPKMG---TIGVAAMSNGTE------------ |
| pssBphP2 | AQGLVIDADPERIFQVLSNLVGNAIKFTPKGG---RINIDAVADQNE------------ |
| pstBphP1 | EPDIKVNADPERLFQVLSNLIGNAIKFTPKLG---RIGVAAMSNGDE------------ |
| rcPpr | ESPLPLTADALRLRQILLNIIGNAVKFTPPGGRVDVRARALAGGG-------------- |
| rlBphP | EDVLLEPQAFSTAALVFHELMTNSAKYGSLSGT-GSGTVQLRWHRDDEGNLR-------- |
| atBphP2 | PQITLDSRAFSVMALVLHELATNAAKYGALSQN--GGQLHVRWDVNENRDCE-------- |
| brBphP | ----------------------------------------------------------- |
| rpBphP1N | ----------------------------------------------------------- |
| rpBphP2N | DRLPFARCDHNQIRQVLQNLIANSLKYRDPAR---PCRIRIFAQPDDNGGRAE------- |
| rpBphP3N | EPLPTVLCDGSQIRQLLQNLISNAVKYRDAER---LPHVTIAATIDSPPPAAP------- |
| rpBphP4N | QNLLDSWSEKSSIEFDLHMTLGSRRLPSPVET----TLYRVLQEALTNVVRHAS------ |
| rpBphP5N | MRLGTAQGHREWIGEVFTNLIGNAIRYND-KP---ERWIEIGVEAGS------------ |
| rpBphP6N | PDVGVDARAYSVLALVLHELATNAAKYGALSRS--SGRLKVAWTVGDDGRCD-------- |
| rrBphP | DTAGEIAANSTELSQIVLNLVGNAADAMGGRG---RVFVSLAEA--------------- |
| rsBphP1 | ----------------------------------------------------------- |
| rsBphP1a | ----------------------------------------------------------- |
| toCphB | RPLPTIMCDRVQVSAIFTNLIANGIKYND-KP---EIWVEIGYLE-------------- |
| xaBphP | ----------------------------------------------------------- |
| xcBphP | ----------------------------------------------------------- |
| anFPH1 | GIPETVIGDQRRVRQSISNLISNAVQNTSSGG----VTVEVWHAPGEGDT---------- |
| bfFPH2 | GIPEMVRGDATRLRQVISNITSNAFQNSVVGG----VKIDIKPIQIWPA----------- |
| chFPH1 | GLPNHCIGDQRRIRQAISNITANAIQHTTQGC----VKVEAYVAARTGR---------- |
| cnFPH1 | DLPRYVVGDSRKIKTVISNLVANSVKFTEKGF----IEVYCGIQRPFDGESSQTSLTESK |
| gmFPH1 | GLPQFVHGDERRIRQALSNVTANAVAHTHSGY----VKVEVFVSEVKDR---------- |
| gzFPH1 | GLPQFVHGDERRIRQALSNVTANAFAHTHKGH----VKVEVFVSEIRDQ---------- |

-continued

| Name/ SEQ ID No | Sequence |
|---|---|
| ncFPH1 | GLPRFVHGDQRRVRQAVANVTANAVKHTSEGS----VRVELYVAEVQDN---------- |
| ncFPH2 | GPTQYVRGDPTSLQRSLSILVANAIQHTTSGQ----VVVKWYETAMNPE---------- |
| umFPH1 | PDVCLVLGDKNRVRQVITNTVTNSVKYTRAGQ----IIVSMRKRNEDEREADLPDG---- |
| aphC | AEIPLVECYAGQMNQVFMNVLSNAIDALED-C---KETKSPNHNGEIIISTSFG------ |
| cph2 | LDALTQVGNRYLFDSTLEREWQRLQRIREPLALLLCDVDFFKGFNDNYGHPAGDR----- |
| npCph2a1 | SELPLVECYAGPLNQVFMNVLSNAIDALED-Y---RESPSKPHSSQITICTAIG------ |
| npCph2a2 | ASLPLIECFAGQLNQVFMNLLANAIDAVEEPC---RQPAKSDKDKHYPRITIKT------ |
| npCph2b | GNIPKVECYAGQMNQVFMNIFSNAIDALEMGT---AEEDKENKPSPVPTIRIST------ |
| arphyA | -------------HLAYLEIRLTHTG------------AGIPELLLNQMFGTE--KDVS |
| asphya3 | -------------HLIDLELRIKHQG------------LGVPAELMAQMFEEDN-KEQS |
| asphya4 | -------------HLIDLELRIKHQG------------LGVPAELMEQMFEEDN-KEQS |
| atphya | -------------HLANLEIRLTHTG------------AGIPEFLLNQMFGTE--EDVS |
| cpphya | -------------HLVHLEFRITYAG------------GGIPESLLNEMFGSE--EDAS |
| cupphya | -------------QLAHLEFRVTHSG------------GGVPEELLTQMFGSD--VDAL |
| gmphya | -------------HLVKLELSITHGG------------SGVPEVLLNQMFGNN--GLES |
| lephya | -------------QLALLEFRIRHTG------------GGVPEELLGQMFGSE--ADAS |
| lsphya | -------------HLVNLELSITHGG------------SGVPEAALNQMFGNN--VLES |
| mgphya | -------------QLVHVEIRITHMG------------GGVPEGLLNQMFGGD--TDTS |
| ntphya | -------------QLALLEVRISHTG------------GGVPEELLSQMFGTE--AEAS |
| omphya | -------------QLGRLECRITH-G------------GGVPQEILNQMFGDEP-TDAS |
| osphya | -------------HLIDLELRIKHQG------------KGVPADLLSQMYEDDN-KEQS |
| pcphya | -------------QLVHLEFRITHTG------------AGVPEEAVSQMFGSD--SETS |
| psphya | -------------HLVNLELSITHGG------------SGVPEAALNQMFGNN--VLES |
| sbphya | -------------HLIDFELRIKHQG------------AGVPAEILSQMYEEDN-KEPS |
| slphya1 | -------------QLANLEFRIMHTG------------GGISEELLSEMFESR--GNAS |
| slphya3 | -------------QHANLEFRISHTG------------GGISEELLSQMFENQ--GEVS |
| slphya4 | -------------QLANLEFRIMHTG------------GGISEELLSEMFESR--GNAS |
| stphya | -------------QLALLEFRIRHTG------------GGVPEELLSQMFGSE--ADAS |
| taphya | -------------HLIDLELRIKHQG------------LGVPAELMAQMFEEDE-PQQS |
| zmphya1 | -------------HLIDFELRIKHQG------------AGVPAEILSQMYGEDN-REQS |
| atphyb | -------------AAIRTEFRMACPG------------EGLPPELVRDMFHSS--RWTS |
| atphyd | -------------SAVRLEFRMACAG------------EGVPPEKVQDMFHSS--RWTS |
| gmphyb | -------------TLLHAEFRMVCPG------------EGLPPELIQDMFNNS--RWGT |
| lephb1 | -------------TVVHIELRIICPG------------EGLPPELVQDMFHSS--RWVT |
| lephb2 | -------------TIVHIEFRIVCPG------------EGLPPELIQDMFHNS--LWVT |
| npphyB | -------------TVVHIEFRIVCPG------------EGLPPELVQDMFHSN--RWVT |
| ntphyb | -------------TVVHIEFRIVCPG------------EGLPPELVQDMFHSS--RWVT |
| osphyb | -------------DTMLFPFRFACPG------------EGLPPEIVQDMFSNS--RWTT |
| pbphyb1 | -------------TLVHMEFKYALLNSF-----------ACLPPELVQDMFHSS--RWVT |

-continued

| Name/ SEQ ID No | Sequence |
|---|---|
| pbphyb2 | -------------TLVHTEFKYLERVLQTRMLGLQHPLRSFLNFKLTLVMLHRE--GMVP |
| sbphyB | -------------DTELFIFRFTYPG------------EGLPADIVQDMFSNS--QWST |
| slphyb | -------------TVAYIEYRLVSPG------------EGLPPDLVQDMFHNS--RWTT |
| stphyb1 | -------------TVVHIELGLYAPG------------R-LPPELVQDMFHSS--RWVT |
| stphyb2 | -------------TVVHIELRIICPG------------EGLPPELVQDMFHSS--RWVT |
| zmphyb1 | -------------NTELFIFRFACPG------------EGLPADVVQDMFSNS--QWST |
| zmphyb2 | -------------DTELFIFRFACPG------------EGLPADIVQDMFSNS--QWST |
| atphyc | -------------KRVELEFRIIHPA------------PGLPEDLVREMFQPL-RKGTS |
| osphyc | -------------QIAHLEFRLVHPA------------PGVPEALIQEMFRHS--PGAS |
| sbphyc | -------------QIAHLEFRIVHPA------------PGVPEALIQEMFRHN--PEVS |
| slphyc | -------------QMFHVEFRITHPL------------PGVPENLIREMFQRS--PGMS |
| taphyc | -------------QIAHLEFRLVHPA------------PGVPEALIQEMFRHG--PGVS |
| zmphyc1 | -------------QIAHLEFRIVHPA------------PGVPEALIQEMFQHN--PGVS |
| zmphyc2 | -------------QIAHLEFRIVHPA------------PGVPEALIQEMFQHN--PGVS |
| lephye | -------------ELIHLQLRMTHPG------------QGLPAALIDDMSGERN-RWTT |
| atphye | -------------RYIHLQFRMIHPG------------KGLPSEMLSDMFETRD-GWVT |
| inphye | -------------VFIHIQFRMTHPG------------QGLPSALIEDMVRGGT-RWTT |
| lephyf | -------------YIMHLEFRITHPS------------PGIPDDLIQHMFHYS--RSIS |
| acvphy1 | -------------HLMHFESRISHSG------------QGISEALVEEMTNKS-QKWTP |
| acvphy2 | -------------HIVHFEFRVSHPG------------SGIPEDLVQQMYDRS--QEIT |
| acvphy3 | --------AVDWWALGILLYEMLYGR------------TPFVGRNRQKTFYNVLNKELI |
| apphy1 | -------------HVAHFEFRVTHPG------------SGIPEDLVQQMYDRS--HEIT |
| cpphy2 | -------------HVMHLEFRVSHPG------------GGLPDELVLEMYDRA--KGMT |
| mcphy1 | -------------TMAHMEFRVTHSG------------EGLPEDLVHQMFDRADAHSKS |
| mpphy1 | -------------HVVHFEFRVTHPG------------AGLPEELVQEMFDRG--RGMT |
| msphy1 | -------------SVANVDFRVSHPG------------EGLPEDLIDQMFDRADARVKS |
| paphy1 | -------------NVMHMEFRITHSG------------QGIPEELIKEMFVHN--QDMF |
| ppphy0 | -------------HVVHLEFRVSHPG------------AGLPEELVLEMYDRG--KGMT |
| ppphy1 | -------------HVVHLEFRVSHPG------------AGLPEELVLEMYDRG--KGMT |
| ppphy2 | -------------HVMHVEFRVTHPG------------LGLPEELVHEMFGRG--RGMT |
| ppphy3 | -------------HVMHLEFRVSHPG------------AGLPEELVLEMFDKG--KGMT |
| ppphy4 | -------------HVMHLEFRVTHSG------------MGLPEELVHEMFDRG--RGMT |
| psphy1 | -------------HVVHLEFRITHPG------------LGLPAELVQDLFDRS--QWAT |
| smphy1 | -------------HVMHLEFRITHPG------------VGLPEELVQEMFDRG--RGMT |
| aphA | ----------------EWLFSVRDNG------------IGIDPQFSDRIFVIFQRLHTR |
| cph1 | ----------------AWVFAVQDNG------------IGIDPQFFERIFVIFQRLHTR |
| cwCph1 | ----------------EWLFSVEDNG------------IGIDPRFSDRIFIIFQRLHTR |
| npCph1 | ----------------AWLFSVRDNG------------IGIDPKFSDRIFVIFQRLHTR |

-continued

| Name/ SEQ ID No | Sequence |
|---|---|
| cwCph1a | ------------------------------------------------------------ |
| npCph1a | GAGEAIIHQSPIPNAPCPIFYIRDNG-------------IGIPQHHLETIFRLFKRLHSQ |
| toCphA | ----------------EWLFSVQDNG-------------IGLEPRFSDRIFVIFQRLHTR |
| aphB | --------------PLPPTFYVRDNG-------------IGIREKHFETIFRIFKRLHSP |
| atBphP1 | ----------------DVTYSVEDNG-------------VGFDMAYYNKLFGVFQRLQRV |
| atBphP3 | ----------------DVTYSVEDNG-------------VGFDMAYYNKLFGVFQRLQRV |
| avAphB | --------------PLPPTFYVRDNG-------------IGIREKHFEAIFRIFKRLHSP |
| chBphP1 | ----------------YYKISYTDNG-------------IGFNKDYNELIFKIFSRLHSV |
| chBphP2 | ------------------------------------------------------------ |
| drbphp | ----------------GWSIAVSDQG-------------AGIAPEYQERIFLLFQRLGSL |
| goBphP | ---------------DQGECTPQLKG-------------TGFGTRMMNAVVNSLSGTLT- |
| krBphP | ------------------------------------------------------------ |
| mmBphP2 | ------------------------------------------------------------ |
| paBphP | ----------------EVCLSVLNET-------------SGLSEAQLANLFEPFKRESAD |
| pfBphP | -----------------IVFTVRDSG-------------EGIPKDHLPHVFDRYWTVKEG |
| ppBphP1 | -----------ISWREMGGPTVRPPSR------------SGFGTVLIDRSIPFDLGGTSA |
| ppBphP2 | ----------------ETEVCIRDNG-------------VGFDMAYANKLFGVFQRLHRM |
| ppkBphP2 | ----------------ETEVCIRDNG-------------VGFDMAYANKLFGVFQRLHRM |
| psBphP1 | -----------------VVFTVRDSG-------------EGIPPEQLPHIFERYWTVKEG |
| psBphP2 | -----------------VLFRVSDDG-------------IGIPAQHLPYIFQRYWSVKEG |
| pssBphP1 | -----------------IVFTVRDSG-------------EGIPPEQLPHIFERYWTVKEG |
| pssBphP2 | -----------------VLFRVSDDG-------------IGIPAEHLPFIFQRYWSVKEG |
| pstBphP1 | -----------------VVFTVRDSG-------------EGIPPEQLPHIFERYWTVKEG |
| rcPpr | -----------------AVFTVRDTG-------------PGMTPEEVLTAMEPFRQVAQT |
| rlBphP | -----------IGWREKDGPPVVEPKR------------HGFGSTIIRRSIPYDLGGKAE |
| atBphP2 | -----------ISWRETLLTTLPAPSR------------AGFGTALISRSIPYDLGGRST |
| brBphP | ------------------------------------------------------------ |
| rpBphP1N | ------------------------------------------------------------ |
| rpBphP2N | -----------IGSAPAIRICVTDNG-------------IGFDKKYIDQVFEPFQRLHGP |
| rpBphP3N | ----------AGANVRRARITIADNG-------------IGFDEQYREQIFEPFQRLHGP |
| rpBphP4N | ------------ARHVSVILQLGDDQ-------------VTMIVEDDGCGFVTAGRKPF- |
| rpBphP5N | ----------------PPRYYVRDNG-------------IGIADTDQQLVFQMFHRVDQS |
| rpBphP6N | -----------IEWTESCGPPVRPPTR------------QGFGTVLLSRSIPFDLGGWSE |
| rrBphP | ------------PDLGRMVITIRDEG-------------PGMTLQTQARVFEPFFTTKPE |
| rsBphP1 | ------------------------------------------------------------ |
| rsBphP1a | ------------------------------------------------------------ |
| toCphB | ----------------PITLYVRDNG-------------IGIRDRHFESIFRIFKRLHGP |
| xaBphP | ------------------------------------------------------------ |
| xcBphP | ------------------------------------------------------------ |

-continued

| Name/ SEQ ID No | Sequence |
|---|---|
| anFPH1 | -------------DKATVKIAVLDTG-------------RGISSSTLELLFRELEQVSGE |
| bfFPH2 | --------------STVISLTVQDVG-------------IGMSESQLDELFQEFEQILDE |
| chFPH1 | -------------DHVDIEVAVSDTG-------------AGMSQKKLDQLFNDLEQVQSE |
| cnFPH1 | EG-----------NTITIEIVISDSG-------------CGIPTVQLEEMFFTLEGAEPL |
| gmFPH1 | --------------QAVVDFVIEDSG-------------IGMSASQLDTLFRDLEQVSSE |
| gzFPH1 | --------------QAVVDFVIEDSG-------------IGMSAGQLDTLFRDLEQVSSE |
| ncFPH1 | --------------RARIDIVVQDSG-------------QGMSNAQLDALFRELEQVDTD |
| ncFPH2 | --------------NTVIHISITDTG-------------PGFSERELDDMFQEFEQVPDE |
| umFPH1 | -------------CDMEVELVVSDTG-------------EGIPQEKLEVIFREFEQVESV |
| aphC | ---------QIRDSIQSIVIRIMDNG-------------PGIPEDLRLRICDPFFTTKPV |
| cph2 | ----------CLKKIADAMAKVAKRP-------------TDLVARYGGEEFAIILSET-- |
| npCph2a1 | ---------ELEGNIKSVVIRIADNG-------------SGIPEALKARICDPFFTTKPV |
| npCph2a2 | ---------QLIAN-DWVQIYIKDNG-------------VGMTKAVQAKLFDPFFTTKPV |
| npCph2b | ---------KISADNSRLLIRISDNG-------------PGMIPEIKKRIFDPFYTTKPV |
| arphyA | E---------------------------EGLSLMVSRKLVKLMN--GDVQYLRQAGKSSF |
| asphya3 | E---------------------------EGLSLLVSRNLLRLMN--GDVRHLREAGVSTF |
| asphya4 | D---------------------------EGLGLLVSRKLLRLMN--GDVRHLREAGVSTF |
| atphya | E---------------------------EGLSLMVSRKLVKLMN--GDVQYLRQAGKSSF |
| cpphya | E---------------------------EGFSLLISRKLVKLMN--GDVRYMREAGKSSF |
| cupphya | E---------------------------EGISLLVSRNLVKLMN--GDVQYHREAGRSAF |
| gmphya | E---------------------------EGISLLIRAKLLKLMN--GDVRYLREAGKSAF |
| lephya | E---------------------------EGISLLVSRKLVKLMN--GEVQYLREAGQSTF |
| lsphya | E---------------------------EGISLHISRKLLKLMN--GDVRYLKEAGKSSF |
| mgphya | E---------------------------EGISLLVSRKLVKLMN--GDVQYLREAGKSTF |
| ntphya | E---------------------------EGISLLISRKLVKLMN--GEVQYLREAGRSTF |
| omphya | E---------------------------DGISLFISRKLVKLMK--GDIQYLREAGRSTF |
| osphya | D---------------------------EGMSLAVSRNLLRLMN--GDVRHMREAGMSTF |
| pcphya | E---------------------------EGISLLISRKLVKLMN--GDVHYLREAGKSTF |
| psphya | E---------------------------EGISLHISRKLLKLMN--GDVRYLKEAGKSSF |
| sbphya | E---------------------------EGLSLLVSRNLLRLMN--GNIRHIREAGMSTF |
| slphya1 | E---------------------------DGISLLISRKLVKLMN--GDIQYLRSAGTSTF |
| slphya3 | E---------------------------EGISLLVSRKIVKLMN--GDVQYLRSAGSSTF |
| slphya4 | E---------------------------DGISLLISRKLVKLMN--GDIQYLRSAGTCTF |
| stphya | E---------------------------EGISLLVSRKLVKLMN--GEVQYLREAGRSTF |
| taphya | E---------------------------EGLGLLVSRNLLRLMN--GDVRHLREAGVSIF |
| zmphya1 | E---------------------------EGLSLLVSRNLLRLMN--GDIRHLREAGMSTF |
| atphyb | P---------------------------EGLGLSVCRKILKLMN--GEVQYIRESERSYF |
| atphyd | P---------------------------EGLGLSVCRKILKLMN--GGVQYIREFERSYF |

-continued

| Name/ SEQ ID No | Sequence |
|---|---|
| gmphyb | Q---------------------------EGLGLSMSRKILKLMN--GEVQYIREAERCYF |
| lephb1 | Q---------------------------EGLGLSMCRKMLKLMN--GEIQYIRESERCYF |
| lephb2 | Q---------------------------QGLGLSMCRRILQLMN--GQVQYIRESERCFF |
| npphyB | K---------------------------EGLGLSMCRKILKLMN--GEIQYIRESERCYF |
| ntphyb | K---------------------------EGLGLSMCRKILKLMN--GDIQYIRESERCYF |
| osphyb | Q---------------------------EGIGLSICRKILKLMG--GEVQYIRESERSFF |
| pbphyb1 | Q---------------------------EGLGLSMCRKILKLMN--GEVQYIRESERCYF |
| pbphyb2 | KI--------------------------QFQGLSVCQGRLIWLSY-PENTTVTLYPLTIW |
| sbphyB | Q---------------------------EGVGLSTCRKILKLMG--GEVQYIRESERSFF |
| slphyb | Q---------------------------EGLGLSMCRKILKLMN--GEVQYIRESERSYF |
| stphyb1 | Q---------------------------EGLGLSMCRKMLKLMN--GEIQYIRESERCYF |
| stphyb2 | Q---------------------------EGLGLSMCRKMLKLMN--GEIQYIRESERCYF |
| zmphyb1 | Q---------------------------EGVGLSTCRKILKLMG--GEVQYIRESERSFF |
| zmphyb2 | Q---------------------------EGVGLSTCRKILKLMG--GEVQYIRESERSFF |
| atphyc | R---------------------------EGLGLHITQKLVKLME-RGTLRYLRESEMSAF |
| osphyc | R---------------------------EGLGLYISQKLVKTMS--GTVQYLREAESSSF |
| sbphyc | R---------------------------EGLGLYICQKLVKTMS--GTVQYLREADTSSF |
| slphyc | R---------------------------GGLSLYISHKLVKIMN--GTLQYLRGEDYSSF |
| taphyc | R---------------------------EGLGLHISQKLVKTMS--GTVQYLREAESSSF |
| zmphyc1 | R---------------------------EGLGLYISQKLVKTMS--GTVQYLREADTSSF |
| zmphyc2 | R---------------------------EGLGLYISQKLVKTMS--GTLQYLREADTSSF |
| lephye | Q---------------------------EGIALNVAQKLLNVMN--GHVRYVRGEDKCYF |
| atphye | P---------------------------DGLGLKLSRKLLEQMN--GRVSYVREDERCFF |
| inphye | Q---------------------------EGVVLHLSQKLVRMMN--GHVHYVREQQKCYF |
| lephyf | R---------------------------EGFGLYISQKLVKIMD--GTVQYLREADRSSF |
| acvphy1 | ----------------------------EGLAISISCTLIRLMN--GDVKYTTDAGNKCF |
| acvphy2 | Q---------------------------EGMGLSVSRKLVKLMN--GDVKYTREAGVCYF |
| acvphy3 | FPTS-------------------IPVSLAGRQLIAGLLQRDPTIRLGTLRGASELKKHPF |
| apphy1 | Q---------------------------EGMGLSVSRKLVKLMN--GEVSYIRDAGLCYF |
| cpphy2 | Q---------------------------EGLGLNMCRKLVRLMN--GDVQYVRENAQCYF |
| mcphy1 | Q---------------------------EGLGLSMCRKIVRLMS--GEVRYVREPGKSYF |
| mpphy1 | Q---------------------------EGLGLNMCRKLLKLMS--GDVQYIREAGKCYF |
| msphy1 | Q---------------------------EGLGLSICRKLVRLMN--GEVQYRREGERNFF |
| paphy1 | Q---------------------------EGLGLYMCQQLVKIMN--GDVQYLREAGRSSF |
| ppphy0 | Q---------------------------EGLGLNMCRKLVRLMN--GDVHYVREAMQCYF |
| ppphy1 | Q---------------------------EGLGLNMCRKLVRLMN--GDVHYVREAMQCYF |
| ppphy2 | Q---------------------------EGLGLSMCRKLVKLMN--GTVQYIRETGKSCF |
| ppphy3 | Q---------------------------EGLGLNICRKLVRLMN--GDVQYVREAMQCYF |
| ppphy4 | Q---------------------------EGLGLSMCRKLVKLMN--GNVQYIRETGKSYF |

-continued

| Name/ SEQ ID No | Sequence |
|---|---|
| psphy1 | Q---------------------------EGVGLSMCRKLLKLMN--GDVRYIRESGICYF |
| smphy1 | Q---------------------------EGLGLSMCRKLVKLMN--GEVEYIREAGKNYF |
| aphA | DE-----------------------YHGTGMGLAICKKIIECHRGRIWVES-QLGEGATF |
| cph1 | DE-----------------------YKGTGMGLAICKKIIEGHQGQIWLES-NPGEGSTF |
| cwCph1 | DE-----------------------YPGTGMGLAICKKIMECHRGKIWVES-EIGQGATF |
| npCph1 | DE-----------------------YTGTGMGLAICKKIVECHRGRIWVES-ELGQGATF |
| cwCph1a | ------------------------------------------------------------ |
| npCph1a | EK----------------------YGGGAGAGLAIVKKIVELHNGQIWVES-TLGVGSIF |
| toCphA | EE-----------------------YPGTGMGLAICKKIIECHRGRIWVES-QLGEGATF |
| aphB | SK----------------------YGGGTGAGLTIAKKIVERHGGKIWVES-TYGEGSTF |
| atBphP1 | ED-----------------------FEGTGIGLALVRRIVERHHGLVGAEG-TVGEGATF |
| atBphP3 | ED-----------------------FEGTGIGLALVRRIVERHHGLVGAEG-TVGEGATF |
| avAphB | NK----------------------YGGGTGAGLTIAKKIVERHGGKIWVES-TYGEGSTF |
| chBphP1 | AE-----------------------YPGSGIGLALCKKIMKTHKGFIEAQG-IPEKGAIF |
| chBphP2 | ------------------------------------------------------------ |
| drbphp | DE-----------------------ALGNGLGLPLCRKIAELHGGTLTVES-APGEGSTF |
| goBphP | ------------------------YTTLTPGLEAVMTLPLDSILPSEADAS-TEAALSQP |
| krBphP | ------------------------------------------------------------ |
| mmBphP2 | ------------------------------------------------------------ |
| paBphP | NQR---------------------NRNGLGIGLYISQAIAQAHQ--GRIDVDCRDDVITF |
| pfBphP | NP------------------------TGTGLGLYITQGIVEAHGGQIVAES-EPGQGSEF |
| ppBphP1 | VE-----------------------YHPEGLQGFFRIPAKHLSVAEAAETA-LPATPLAR |
| ppBphP2 | ED-----------------------FEGTGIGLASVRRIIERHDGRVWATG-QVDQGASF |
| ppkBphP2 | ED-----------------------FEGTGIGLASVRRIIERHDGRVWATG-QVDQGASF |
| psBphP1 | NP------------------------TGTGLGLYISQGIIKAHGGELAAQS-QVGHGSEF |
| psBphP2 | NP------------------------RGNGLGLYICQGIITAHGGRLWADS-SLDSGSVF |
| pssBphP1 | NP------------------------TGTGLGLYISQGIIKAHGGELAAQS-QVGEGSEF |
| pssBphP2 | NP------------------------RGNGLGLYICQGIITAHGGRLWADS-SLDSGSVF |
| pstBphP1 | NP------------------------TGTGLGLYISQGIIKAHGGELAAQS-QVGHGSEF |
| rcPpr | RA----------------------AVEGTGLGLPIAKSLVDLHAGNLAIET-APGLGTTV |
| rlBphP | VR-----------------------YVEDGLEADFSIPARHVVGP-TSERSNPLPVGATG |
| atBphP2 | IR-----------------------YLPNGLEAEILLPFRHVSSVSAAFET-KTEAETLP |
| brBphP | ------------------------------------------------------------ |
| rpBphP1N | ------------------------------------------------------------ |
| rpBphP2N | DD-----------------------YEGSGIGLAICRKIVQRHGGRVGVDT-VPGQGSTF |
| rpBphP3N | DE-----------------------YQGTGIGLAICRKIVHRHGGTISATS-RVGEGSVF |
| rpBphP4N | ---------------------------SGRLGLLGIRERLSLVGGSLEIES-APGKGTAL |
| rpBphP5N | EQ----------------------KAEGAGVGLAMTRRIVAHHGGRIWVQS-RLGEGATF |

-continued

| Name/ SEQ ID No | Sequence |
|---|---|
| rpBphP6N | VD-----------------------YLPGGVVARLGIPGQFVTETLQRLSS-VQASGQST |
| rrBphP | GS-------------------------GTGMGLAVVHGLVEAWGGTIGLES-APGSGTKF |
| rsBphP1 | ------------------------------------------------------------ |
| rsBphP1a | ------------------------------------------------------------ |
| toCphB | TQ----------------------YGGGTGAGLTIAKKVVERHGGKIWVES-TYGEGSTF |
| xaBphP | ------------------------------------------------------------ |
| xcBphP | ------------------------------------------------------------ |
| anFPH1 | DDSH-YYGGSEEGEESAPEAKASKDKAVLGLGLALVARIVRNMHGQLTVRS-EEGKGSRF |
| bfFPH2 | TD---------HSTIKKPAQPLIDVKETLGIGLAVVARYVRNSNGQIRVHS-EVGKGTIF |
| chFPH1 | PA----SMLEDALIPDQKKLAEQGEKSTLGLGLAIVGRIIRNMNGQLRLRS-EEGKGTRF |
| cnFPH1 | QKN-----------------------TGVGLGLAVVARIVEQLEGQLRAES-EVGVGTRF |
| gmFPH1 | EA----------PMSGTKLEEMPREMRTLGLGLAVVARIVRNMDGQLRLKS-EVGQGSRF |
| gzFPH1 | DA----------PTS-SSLDDMPREMRTLGLGLAVVARIVRNMDGQLRLKS-EVGQGSRF |
| ncFPH1 | IG------------SESSDDDNSQSGKALGLGLAVVARILRNMDGQLRLKS-EVGKGSRF |
| ncFPH2 | DF----------DEATSKPHAVRDNVLRVGVGLAFVARFVKQRNGQLKVKS-TKGRGSTF |
| umFPH1 | IAQPGRQDLSEPEGSEASLLRTEPSDSGLGLGLAIVARVVKNLGGQLRVDS-QVGEGTSF |
| aphC | GK-------------------------GTGLGLSISYKIVVDRHGGVFKCDSQLGSGTEF |
| cph2 | ---------------------------SLEGAINVTEALQVEVANLAIPHTVSGTGHVTL |
| npCph2a1 | GK-------------------------GTGLGLSISYQIVVDKHGGVFKCDSQPGLGTEF |
| npCph2a2 | GQ-------------------------GTGLGLSISYQIVEKH-GGKLQCLSQPGEGAQF |
| npCph2b | GR-------------------------GTGLGLAISYQIIVEKHGGIMECISEPGIGTEF |
| arphyA | IISAELAAAN----K--------------------------------------------- |
| asphya3 | IITAELASAP----TAMGQ----------------------------------------- |
| asphya4 | ILTAELASAP----TAIGQ----------------------------------------- |
| atphya | IITAELAAAN----K--------------------------------------------- |
| cpphya | IITVELAAAH----KSRTT----------------------------------------- |
| cupphya | IISVELAVAT----KPRA------------------------------------------ |
| gmphya | ILSAELAAAH----NLKA------------------------------------------ |
| lephya | IISVELAVAT----NSS------------------------------------------- |
| lsphya | ILSVELAAAH----KLKG------------------------------------------ |
| mgphya | IISVELAAAA----NKSTCE---------------------------------------- |
| ntphya | IISVELAVAT----KSSC------------------------------------------ |
| omphya | IISVEIAISN----KPNL------------------------------------------ |
| osphya | ILSVELASAP----AK-------------------------------------------- |
| pcphya | IITVELAAAS----KRES------------------------------------------ |
| psphya | ILSVELAAAH----KLKG------------------------------------------ |
| sbphya | ILTAELAAAP----SAVGQ----------------------------------------- |
| slphya1 | IISVELAVAG----NSS------------------------------------------- |
| slphya3 | IISVELAIAG----NSL------------------------------------------- |

-continued

| Name/ SEQ ID No | Sequence |
|---|---|
| slphya4 | IIYVELAVAD----NSS------------------------------------------- |
| stphya | IISVELAVAT----KSS------------------------------------------- |
| taphya | ILTAELACAP----TAMEH----------------------------------------- |
| zmphya1 | ILTAELAAAP----SAAGH----------------------------------------- |
| atphyb | LIILELPVPRKRPLSTASGSGDMMLMMPY------------------------------- |
| atphyd | LIVIELPVP-------------LMMMMPS-S----------------------------- |
| gmphyb | YVLLELPVT----RRSSKKC---------------------------------------- |
| lephb1 | MIILDLPMT----RKGPKSVG--------------------------------------- |
| lephb2 | LIILQLPML----IQ--------------------------------------------- |
| npphyB | LIILDLPMT----GRGSKSVG--------------------------------------- |
| ntphyb | LIILDLPMT----RRGSKSLG--------------------------------------- |
| osphyb | HIVLELPQP---QQAASRGTS--------------------------------------- |
| pbphyb1 | LVILEVPMPNKCERYNCKKCCRLGCLVCN-VY---------------------------- |
| pbphyb2 | FLLLYRRQS-----RSITHT---------------------------------------- |
| sbphyB | LIVLELPQPRP---AADREIS--------------------------------------- |
| slphyb | FVILELRMPP----KQLMNVE--------------------------------------- |
| stphyb1 | LIILDLPMTR----KGPKSVG--------------------------------------- |
| stphyb2 | LIILDLPMTR----KGPKSVG--------------------------------------- |
| zmphyb1 | LIVLEQPQPR---PAAGREIV--------------------------------------- |
| zmphyb2 | LIVLELPQPR---LAAGRENQLIC------------------------------------ |
| atphyc | VILTEFPLI--------------------------------------------------- |
| osphyc | IVLVEFPVAQ----LSTKRCKASTSKF--------------------------------- |
| sbphyc | IILIEFPVAQ----LSSKRSKPSTSKF--------------------------------- |
| slphyc | IVFLEFPVA--------------------------------------------------- |
| taphyc | IVLVEFPVAQ----LNSKRSRPSTSKSNF------------------------------- |
| zmphyc1 | IILMEFPVAQ----LSSKRSKPSTSKF--------------------------------- |
| zmphyc2 | IILIEFPVAQ----LSSKRSKPSPSKF--------------------------------- |
| lephye | LIDVELQTLK-PTQHGPKLEVTQEIEI--------------------------------- |
| atphye | QVDLQVKTMLGVESRGTEGSSSIK------------------------------------ |
| inphye | LIDLDFKTQK-PRSRESSMDTKAD------------------------------------ |
| lephyf | IILVEFPLME----KKNN------------------------------------------ |
| acvphy1 | LVTIQFPLAH---RDDATSVR--------------------------------------- |
| acvphy2 | LVTVELPLVQ---EDD-------------------------------------------- |
| acvphy3 | FREINWPLIRWRKFSANQAHNANNVSSLD-EGESDSGNAWEANGGSTQSFQDTF------ |
| apphy1 | WSMLELPVVQ---SGKQAMF---------------------------------------- |
| cpphy2 | VVYVELPMAQ---RDDAASQM--------------------------------------- |
| mcphy1 | LVLLDLPLAQ---REDAGSAM--------------------------------------- |
| mpphy1 | LVNVELPIAQ---RDDAGSVK--------------------------------------- |

-continued

| Name/ SEQ ID No | Sequence |
|---|---|
| msphy1 | LLQLELPLAQ---RDDQASMK--------------------------------------- |
| paphy1 | IINVEFPLAQ---TDKQ------------------------------------------- |
| ppphy0 | VVNVELPMAQ---RDDASSQCRSLYSYLL-A----------------------------- |
| ppphy1 | VVNVELPMAQ---RDDASSQM--------------------------------------- |
| ppphy2 | LVEVELPLAQ---RDDAGSVRSTVV----------------------------------- |
| ppphy3 | VLYVELPLAQ---QDDAASQM--------------------------------------- |
| ppphy4 | LVEVELPLAQ---RDDAGSVR--------------------------------------- |
| psphy1 | LVNVEFPMAQ---REDAASIK--------------------------------------- |
| smphy1 | LVSLELPLAQ---RDDAGSVKFQASS---------------------------------- |
| aphA | YFTIPVGGRERERRNGRKTQNNLFS----------------------------------- |
| cph1 | YFSIPIGN---------------------------------------------------- |
| cwCph1 | YFTIPVGGTERDRKRGSTR----------------------------------------- |
| npCph1 | YFTIPVGGRELERRNGRKTQNHLFGRGQ-------------------------------- |
| cwCph1a | ------------------------------------------------------------ |
| npCph1a | YFTLE------------------------------------------------------- |
| toCphA | YFTIPVGGRERERRNGRQTQKDLFGRG--------------------------------- |
| aphB | YFTLQDV----------------------------------------------------- |
| atBphP1 | SFTLPVTKVEEEKIA--------------------------------------------- |
| atBphP3 | SFTLPVTKVEEEKIA--------------------------------------------- |
| avAphB | YFTLQGV----------------------------------------------------- |
| chBphP1 | YLYFPVSKNS-------------------------------------------------- |
| chBphP2 | ------------------------------------------------------------ |
| drbphp | RCWLPDAGPLPGAADA-------------------------------------------- |
| goBphP | PYPYP------------------------------------------------------- |
| krBphP | ------------------------------------------------------------ |
| mmBphP2 | ------------------------------------------------------------ |
| paBphP | CLRLPVRQAETGSSS--------------------------------------------- |
| pfBphP | RFTVPRLD---------------------------------------------------- |
| ppBphP1 | ANGAFAARS-GLCVLILEDQLVIAVGLEQ-ILNDAQIKDVITASSEDQAMQLLGSHKPDA |
| ppBphP2 | HFTLPRNTAT-------------------------------------------------- |
| ppkBphP2 | HFTLPRNTAT-------------------------------------------------- |
| psBphP1 | RFTVPIAH---------------------------------------------------- |
| psBphP2 | SFTLPMHQGQDT-------------------IGESTFLKQSGTTHRLAQSISSKLERQQL |
| pssBphP1 | RFTVPMAV---------------------------------------------------- |
| pssBphP2 | SFTLPVHQGTDS-------------------IGETTFLKQSGTTHRLAQSISSKLERQQL |
| pstBphP1 | RFTVPIAH---------------------------------------------------- |
| rcPpr | TIEIGA------------------------------------------------------ |
| rlBphP | RKTIPDDQPLSGLNVLLVENNLIIAMDGEDILRRLGADVATAPSVTE-AMEILAGQSFDL |
| atBphP2 | QPRRYNREE-PLKVLLVEDQMLIAMDVEN-MLEDNGIKAIETATSSAMAIEKLKTYLPDV |

-continued

| Name/ SEQ ID No | Sequence |
|---|---|
| brBphP | ------------------------------------------------------------ |
| rpBphP1N | ------------------------------------------------------------ |
| rpBphP2N | WFTLPVSDDHGQG----------------------------------------------- |
| rpBphP3N | TFTLPLCDQDAAES---------------------------------------------- |
| rpBphP4N | YARIPL------------------------------------------------------ |
| rpBphP5N | YFTLAPDEERHDA----------------------------------------------- |
| rpBphP6N | DSSALNIADAS---ILLVEDQLVIALDAEDMLGAIGAKLVTSVASAEEALQTIAQQPPTL |
| rrBphP | VISFPINNP--------------------------------------------------- |
| rsBphP1 | ------------------------------------------------------------ |
| rsBphP1a | ------------------------------------------------------------ |
| toCphB | YFTLQEVK---------------------------------------------------- |
| xaBphP | ------------------------------------------------------------ |
| xcBphP | ------------------------------------------------------------ |
| anFPH1 | QISLQFPIPEGSDTKS----------PTA-EHRPVATGDSAAP-------FSTGDDVILV |
| bfFPH2 | GIELPFEH------------------------------APAASNTQEIPIISTGRQIRPF |
| chFPH1 | VIQLPFEIPDSEADSV----------TTG-GASPAGSVTPHAEESLPNVVSSTAGERTLI |
| cnFPH1 | YFNVPMVAHP------------SGRPGSR-QSSHNSRNTNSSQLRTRTGSSGSKS--DSV |
| gmFPH1 | VVQLPFLLSNECPSSHGNEN-LPTSVPTN-KSTNSAESANTATSAPLSLTAAPEGEITLV |
| gzFPH1 | VVQLPFLLSDQYSGSH------LKSAPAG-RGNQSFNSTSTASTAPDALRAAPEGEITLV |
| ncFPH1 | VIQLPFDLPEEETSRDTVG------ASSG-NTAQLSLGSGTASASAASVTQMQDGEVMLV |
| ncFPH2 | TLEIPFAVS-----------------------SHCSSIASRRRDASPLPVLTMPG----- |
| umFPH1 | TYYIPFCSAETTTPTEMPPIGSSGGSGTK-RSSDTISMRRSTSMGSGSASSAGRSEIDSL |
| aphC | WIEIPIQQVNGNW----------------------------------------------- |
| cph2 | SIGIAVYTPERHINPNALVKAADLALYEA-KAKGRNQWLAYEGSQLPHVDGEV------- |
| npCph2a1 | WIEIPVSQITKF------------------------------------------------ |
| npCph2a2 | VIEIPIKQSERELANVLIDKKESDTDNS-------------------------------- |
| npCph2b | WIEIPVKPPAKIVYSR-------------------------------------------- |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |

-continued

| Name/ SEQ ID No | Sequence |
|---|---|
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |

-continued

| Name/ SEQ ID No | Sequence |
|---|---|
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | AILDVNLGTGTSISVADELVRRQVPFLFATGYGDGISIPEHLQHVPVARKPYDANAILAS |
| ppBphP2 | ------------------------------------------------------------ |
| ppkBphP2 | ------------------------------------------------------------ |
| psBphP1 | ------------------------------------------------------------ |

-continued

| Name/ SEQ ID No | Sequence |
|---|---|
| psBphP2 | ED----------------------------------------------------RLTRAG |
| pssBphP1 | ------------------------------------------------------------ |
| pssBphP2 | ED----------------------------------------------------RLTRAG |
| pstBphP1 | ------------------------------------------------------------ |
| rcPpr | ------------------------------------------------------------ |
| rlBphP | ALLDVNLGDETSFGIADRLAADGVPFVFATGYGEGIAQANSHSDAPVLQKPYTMEGVTDI |
| atBphP2 | AILDINLGSDTSIPVARELHRRGIPFLFATGYADGSMVPDEFGAVPVIRKPYDEDALMAG |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | AILDVNLGNGSSLPVADELERLGIPFIFATGYGDTAMIPERMRGLPIVRKPYSIDSLRGA |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | D---STTGSKRNSQ-DSL------------------------------------------ |
| bfFPH2 | S----DSGSNYDES---------------------------------------DKMNSTY |
| chFPH1 | APSLSRQGSAGEDDKQTSNVVVRKTSAGSLASKNSLRSFKTSSSQRSDVDRLIDAIQEPH |
| cnFPH1 | VS------LRSDGS--GVPEIESFVQDFG-----GSHLPAPVGDDDPRLLEAQERMSRLG |
| gmFPH1 | D---RVSSMTSAVEGGDASMKGSRASQRSMSSH---------GSHQSDADRLIDAISTPL |
| gzFPH1 | D---RASTMASAG---DISLKGSGASQRSMGSHTSHSSRGSRGSHQSDADRLINAIQTPL |
| ncFPH1 | D---RNNGSSWSVNNATGSLASKKSYDDNLSITS----KGSGRSALSDADRLIDAIQNPL |
| ncFPH2 | ----------------------------------------------------------PL |
| umFPH1 | VEAIQQPVLRDQATSEDVVARRRTAEGVSPGLIHGSKIVSAGSIHRPEYAAQRTRSFDSG |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |

-continued

| Name/ SEQ ID No | Sequence |
|---|---|
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |

-continued

| Name/ SEQ ID No | Sequence |
|---|---|
| zmphyc1 | ------------------------------------------------------------- |
| zmphyc2 | ------------------------------------------------------------- |
| lephye | ------------------------------------------------------------- |
| atphye | ------------------------------------------------------------- |
| inphye | ------------------------------------------------------------- |
| lephyf | ------------------------------------------------------------- |
| acvphy1 | ------------------------------------------------------------- |
| acvphy2 | ------------------------------------------------------------- |
| acvphy3 | ------------------------------------------------------------- |
| apphy1 | ------------------------------------------------------------- |
| cpphy2 | ------------------------------------------------------------- |
| mcphy1 | ------------------------------------------------------------- |
| mpphy1 | ------------------------------------------------------------- |
| msphy1 | ------------------------------------------------------------- |
| paphy1 | ------------------------------------------------------------- |
| ppphy0 | ------------------------------------------------------------- |
| ppphy1 | ------------------------------------------------------------- |
| ppphy2 | ------------------------------------------------------------- |
| ppphy3 | ------------------------------------------------------------- |
| ppphy4 | ------------------------------------------------------------- |
| psphy1 | ------------------------------------------------------------- |
| smphy1 | ------------------------------------------------------------- |
| aphA | ------------------------------------------------------------- |
| cph1 | ------------------------------------------------------------- |
| cwCph1 | ------------------------------------------------------------- |
| npCph1 | ------------------------------------------------------------- |
| cwCph1a | ------------------------------------------------------------- |
| npCph1a | ------------------------------------------------------------- |
| toCphA | ------------------------------------------------------------- |
| aphB | ------------------------------------------------------------- |
| atBphP1 | ------------------------------------------------------------- |
| atBphP3 | ------------------------------------------------------------- |
| avAph3 | ------------------------------------------------------------- |
| chBphP1 | ------------------------------------------------------------- |
| chBphP2 | ------------------------------------------------------------- |
| drbphp | ------------------------------------------------------------- |
| goBphP | ------------------------------------------------------------- |
| krBphP | ------------------------------------------------------------- |
| mmBphP2 | ------------------------------------------------------------- |

-continued

| Name/ SEQ ID No | Sequence |
| --- | --- |
| paBphP | ------------------------------------------------------------ |
| pfBphP | ------------------------------------------------------------ |
| ppBphP1 | LQSLLELG---------------------------------------------------- |
| ppBphP2 | ------------------------------------------------------------ |
| ppkBphP2 | ------------------------------------------------------------ |
| psBphP1 | ------------------------------------------------------------ |
| psBphP2 | LLNELNHRVKNTLATVQAIASLTVNSSTSLDSFRKSFDAR-------------------- |
| pssBphP1 | ------------------------------------------------------------ |
| pssBphP2 | LLNELNHRVKNTLATVQAIASLTVNSSASLESFHKSFGAR-------------------- |
| pstBphP1 | ------------------------------------------------------------ |
| rcPpr | ------------------------------------------------------------ |
| rlBphP | LARVPLPRRE-------------------------------------------------- |
| atBphP2 | IGVLVGDTERV------------------------------------------------- |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | LSAMLDDRE--------------------------------------------------- |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | --TRPDVPRKSEPED-TAPADGAGEQASGESEAQTRPKKTGESTASTSHEQSETAR---- |
| bfFPH2 | TMSNFGSTPLATPIE---EGSSATTSFFDLAMHSKEEYVEPPSVRRRSSLP--------- |
| chFPH1 | LIGRGDTSPGSRSMRPTLTKRSSLDANASAAARRRSKSLEDFSNQTVVPPHQRIMQS--- |
| cnFPH1 | TFPVTDSSYPVRATKVN-----TDDQHVKSPK--------------PKKPRFTAIGS--- |
| gmFPH1 | SLNDREGSEYPLPAS-VRSGGSSMRPTSRGAVSLSGRSVSP----PQSPVATKPHS---- |
| gzFPH1 | SLNEREGTEFPIQGG-RGSRSNSMRAESRGAISLDGRSASPSDQQPQSPVSTKPRS---- |
| ncFPH1 | TLGEPEP-ESVARQR-RNSRGPYYNPSSSLLGSSKGRSVSPGSRKRPDVPTRSVSSPNTK |
| ncFPH2 | TFGAGSSVPSDRSTF--GTSRDSKPSPPIIRPGSSTADTSPRDFQTPSPHH--------- |
| umFPH1 | SHPVEGSGIPVRSVKINPQALDANDRADRRPASSSAFLLSATTHARPVKPSHTSAAESFK |
| aphC | ------------------------------------------------------------ |
| cph2 | ------------------------------------------------------------ |
| npCph2a1 | ------------------------------------------------------------ |

-continued

| Name/ SEQ ID No | Sequence |
|---|---|
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |

-continued

| Name/ SEQ ID No | Sequence |
| --- | --- |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |

-continued

| Name/ SEQ ID No | Sequence |
|---|---|
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ----------------------SRPSGPSSGPSAPERRP--------------------- |
| bfFPH2 | ----------------------FLNMIDLMSSKKS------------------------- |
| chFPH1 | ---------------------TVPGKEAIPGSDAPVVALKVPDEGGSSPIGVRPSGN--- |
| cnFPH1 | -------------------------------SERSTSRHNTTSSKT-SSASQSPAFS--- |
| gmFPH1 | ----------------------EPGSTGVVDSKTPIRAVKIPDEYSDVPQRPQPSEHSR- |
| gzFPH1 | ----------------------EPGSTEVMDSKTPIRAVKMPDDYTDMPQKPQPSEQSG- |

-continued

| Name/ SEQ ID No | Sequence |
|---|---|
| ncFPH1 | KDLPFEKPTTEVAPGPSEPAPAAQGVQYVTDSRVPIKPVKLPDEMFDKPVVPPQSTSKVL |
| ncFPH2 | ------------------------------------------------------------ |
| umFPH1 | AEVEQRFRDKVPQLAQATLPVDASKLRSCQMADKEATVSPTTRAKSGVEAPQNEAVSPDC |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |

-continued

| Name/ SEQ ID No | Sequence |
|---|---|
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |

-continued

| Name/ SEQ ID No | Sequence |
|---|---|
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | --------------------------------------------LFALSQA-----RAEW |
| pssBphP1 | ------------------------------------------------------------ |
| pssBphP2 | --------------------------------------------LFALSQAHDALARAEW |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |

-continued

| Name/<br>SEQ ID No | Sequence |
|---|---|
| xcBphP | ------------------------------------------------------------ |
| anFPH1 | ---------------------------------------------LRVLVAEDDPINAKI |
| bfFPH2 | ---------------------------------------------LSILIAEDNPINSKL |
| chFPH1 | ------ILGEVAEDKPIQPAAEPEPLS---------------ADNMHVLVAEDDPVNSRI |
| cnFPH1 | ------------RPSSNSVQGPKR-------NKKGPNGK----TVMRIMVVEDDPINSQI |
| gmFPH1 | -----VLFEMKGNDRPVTKAATESITS--------GGTQMTESQHLEVLVAEDDPINMKI |
| gzFPH1 | -----VLFEMKTIDRPVAKAGTESVTS--------AGTQMTDQQHLQVLVAEDDPINMKI |
| ncFPH1 | FEIKDAVADKAKAASSAVKEQQSVSSQQPAPPPAPAKEASTTNNKLQVLVAEDDPINVKV |
| ncFPH2 | ---------------------------------------------YTVIVADDNMINVQI |
| umFPH1 | GDVHMAKRSSDERRSSSSSSVAKRRLAVMRGLHKAPGGRGEKIAPLRVLVVEDDPINRMI |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |

-continued

| Name/ SEQ ID No | Sequence |
|---|---|
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |

-continued

| Name/ SEQ ID No | Sequence |
|---|---|
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | MSTELADLLAQLQDVNGGQHRITFTGDPVR-----------------LEPRISLTLSMVL |
| pssBphP1 | ------------------------------------------------------------ |
| pssBphP2 | ISTELVDLIEQLQEQDSGAHRISFEGDPVT-----------------LEPRFSLTLSMVL |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |

-continued

| Name/ SEQ ID No | Sequence |
|---|---|
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | IEKRLEKLGHTVQRTVNGEECANAY-----------SAESTQWDVVLMDIQMPILDGIES |
| bfFPH2 | LHKRLSKLSHKPEITAEGQSCYDYYT-----------SGNNKVDVILMDLQMPLVDGTKA |
| chFPH1 | VKKRLEKLGHHVHLTVNGEECASAYC-----------DNSKDIDVVLMDMQMPIVDGLTS |
| cnFPH1 | LQKRLKMDKHVVVAVTNGQEAVDQLEKD------------RDIDAILMDIQMPIMDGRTS |
| gmFPH1 | LRKRLERVGHGVHHTANGEDCAAAYR-----------ERSKEFDVVLMDMQMPIVDGLTS |
| gzFPH1 | LRKRLERVGHGVHHTVNGEDCAAAFR-----------ERSSEFDVVLMDMQMPIVDGLTS |
| ncFPH1 | LRKRLEKAGYKVTHALNGEDCAAVYE-----------DKPVVFDVVLMDMQMPIVDGLTS |
| ncFPH2 | LERRLTKLGHRVLVSRDGQECFNLFA-----------SNRSTVDFVLMDLNMPVVDGFAS |
| umFPH1 | LKKRLGLDGHTTLLAVNGEEGVRQFEQDA-----------KEIDVILMDLQMPICNGQEA |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |

-continued

| Name/<br>SEQ ID No | Sequence |
|---|---|
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |

-continued

| Name/ SEQ ID No | Sequence |
|---|---|
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | HKLMANALQHGALSSPAGQVTVASTLNSHHNPPTLSIDWLETEGPPVVASNVKGFGLRLI |
| pssBphP1 | ------------------------------------------------------------ |
| pssBphP2 | HELMANALQHGALSSASGQVTVTSTLTAEHTPPTLKIEWKETGGPPVVATTVKGFGLRLI |
| pstBphP1 | ------------------------------------------------------------ |
| rcPpr | ------------------------------------------------------------ |
| rlBphP | ------------------------------------------------------------ |

-continued

| Name/ SEQ ID No | Sequence |
|---|---|
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | TKRIRQHE----------SQSEVANL--HIPIFAVSASLLEKDVQMYMDIGFDGWIMKPI |
| bfFPH2 | TRMIRKFERDNLE---------LHQIRRVPIIAASASLLEEHRFDYIEAGFDGWIMKPI |
| chFPH1 | TKMIRSFEKSHSN------------------MYSPRAAL--------------------- |
| cnFPH1 | AKEIRELEARTP----QPDDIEPFKVDGRTPIFAVSASLYEDDRANLAEN-FDGWLLKPL |
| gmFPH1 | TKMIRSMEASGEH----QGHSSLANSNYRIPIFAVSASLVEREKQTYVDAGFDGWILKPI |
| gzFPH1 | TKMIRSMEASADY----HGHSALANTNHRIPVFAVSASLVEREKQKYIDAGFDGWILKPI |
| ncFPH1 | TKMIRAFEKTNRDGS-GQQLSDIASDHGRVPIFAVSASLVEQEKDTYVDAGFDGWILKPI |
| ncFPH2 | IRMIRDQEYSHPT------PSRVVQCCGRTPIFAVSGMLRRGQEQQCKEAGFDGWMPKPV |
| umFPH1 | CIRIRDLEHKWAERGEQADRPASQILNGRVPILAVSATLVPQMRQEMVDIGMDGWLLKPI |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |

-continued

| Name/<br>SEQ ID No | Sequence |
|---|---|
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |

-continued

| Name/ SEQ ID No | Sequence |
|---|---|
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |

-continued

| Name/ SEQ ID No | Sequence |
|---|---|
| psBphP2 | RRSIERELKGKVDIKFASTGVSWSMLIPWPEKPESSL----------------------- |
| pssBphP1 | ------------------------------------------------------------ |
| pssBphP2 | RRSIERELKGQADIQFARTGIIWSMLIPWPDKPESRL----------------------- |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | NFVRLNTLLAGIHEERARNGAVYQPG-QWEKGGWFTPYTHS------------------- |
| bfFPH2 | NFSRLEFLLQGLNNPQLKQRSLYTPG-MWELGGWFFA----------------------- |
| chFPH1 | ------------------------------------------------------------ |
| cnFPH1 | DFSRVRAILEGLESSEKRGAEVYQQG-NWERGGYLKAAPLP--------------ASSSA |
| gmFPH1 | DFKRLNTLLAGISDEEVRKSCLYEPG-QWERGGWFLSRAVLGGSVTSDETTPKAVPDAKD |
| gzFPH1 | DFKRLNTLLAGISDEEVRNSCLYESG-QWERGGWFHPRSLVGGSEASDETTPRAEHDAKD |
| ncFPH1 | DFKRLETLLQGITDDKARNDALYVQG-QWERGGWFEKKGVGNMGQEQEENHEQ------- |
| ncFPH2 | DMKRLVRCLAGGLDPNARRMCVYDEK-RFELGGWFDAE---------------------- |
| umFPH1 | DFARLGALLKGLLHPEDRVANHWRSGYVWEKGGWLSEPAQRSVLVAPSAVSEMIGHSSSN |
| aphC | ------------------------------------------------------------ |
| cph2 | ------------------------------------------------------------ |
| npCph2a1 | ------------------------------------------------------------ |
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |

-continued

| Name/ SEQ ID No | Sequence |
|---|---|
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |

-continued

| Name/ SEQ ID No | Sequence |
|---|---|
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |

-continued

| Name/ SEQ ID No | Sequence |
|---|---|
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | STPSTTQSSPCTSTS--------------------------------------------- |
| gmFPH1 | KDIGN-TVAAEEAKAESDASEPAPST---------------------------------- |
| gzFPH1 | KDIGETAIISEDAKETGGAGEAKPDND--------------------------------- |
| ncFPH1 | ------------------------------------------------------------ |
| ncFPH2 | ------------------------------------------------------------ |
| umFPH1 | ASNANPLSPPLSSPSA-------------------------------------------- |
| aphC | ------------------------------------------------------------ |
| cph2 | ------------------------------------------------------------ |
| npCph2a1 | ------------------------------------------------------------ |

-continued

| Name/ SEQ ID No | Sequence |
|---|---|
| npCph2a2 | ------------------------------------------------------------ |
| npCph2b | ------------------------------------------------------------ |
| arphyA | ------------------------------------------------------------ |
| asphya3 | ------------------------------------------------------------ |
| asphya4 | ------------------------------------------------------------ |
| atphya | ------------------------------------------------------------ |
| cpphya | ------------------------------------------------------------ |
| cupphya | ------------------------------------------------------------ |
| gmphya | ------------------------------------------------------------ |
| lephya | ------------------------------------------------------------ |
| lsphya | ------------------------------------------------------------ |
| mgphya | ------------------------------------------------------------ |
| ntphya | ------------------------------------------------------------ |
| omphya | ------------------------------------------------------------ |
| osphya | ------------------------------------------------------------ |
| pcphya | ------------------------------------------------------------ |
| psphya | ------------------------------------------------------------ |
| sbphya | ------------------------------------------------------------ |
| slphya1 | ------------------------------------------------------------ |
| slphya3 | ------------------------------------------------------------ |
| slphya4 | ------------------------------------------------------------ |
| stphya | ------------------------------------------------------------ |
| taphya | ------------------------------------------------------------ |
| zmphya1 | ------------------------------------------------------------ |
| atphyb | ------------------------------------------------------------ |
| atphyd | ------------------------------------------------------------ |
| gmphyb | ------------------------------------------------------------ |
| lephb1 | ------------------------------------------------------------ |
| lephb2 | ------------------------------------------------------------ |
| npphyB | ------------------------------------------------------------ |
| ntphyb | ------------------------------------------------------------ |
| osphyb | ------------------------------------------------------------ |
| pbphyb1 | ------------------------------------------------------------ |
| pbphyb2 | ------------------------------------------------------------ |
| sbphyB | ------------------------------------------------------------ |
| slphyb | ------------------------------------------------------------ |
| stphyb1 | ------------------------------------------------------------ |
| stphyb2 | ------------------------------------------------------------ |

-continued

| Name/ SEQ ID No | Sequence |
|---|---|
| zmphyb1 | ------------------------------------------------------------ |
| zmphyb2 | ------------------------------------------------------------ |
| atphyc | ------------------------------------------------------------ |
| osphyc | ------------------------------------------------------------ |
| sbphyc | ------------------------------------------------------------ |
| slphyc | ------------------------------------------------------------ |
| taphyc | ------------------------------------------------------------ |
| zmphyc1 | ------------------------------------------------------------ |
| zmphyc2 | ------------------------------------------------------------ |
| lephye | ------------------------------------------------------------ |
| atphye | ------------------------------------------------------------ |
| inphye | ------------------------------------------------------------ |
| lephyf | ------------------------------------------------------------ |
| acvphy1 | ------------------------------------------------------------ |
| acvphy2 | ------------------------------------------------------------ |
| acvphy3 | ------------------------------------------------------------ |
| apphy1 | ------------------------------------------------------------ |
| cpphy2 | ------------------------------------------------------------ |
| mcphy1 | ------------------------------------------------------------ |
| mpphy1 | ------------------------------------------------------------ |
| msphy1 | ------------------------------------------------------------ |
| paphy1 | ------------------------------------------------------------ |
| ppphy0 | ------------------------------------------------------------ |
| ppphy1 | ------------------------------------------------------------ |
| ppphy2 | ------------------------------------------------------------ |
| ppphy3 | ------------------------------------------------------------ |
| ppphy4 | ------------------------------------------------------------ |
| psphy1 | ------------------------------------------------------------ |
| smphy1 | ------------------------------------------------------------ |
| aphA | ------------------------------------------------------------ |
| cph1 | ------------------------------------------------------------ |
| cwCph1 | ------------------------------------------------------------ |
| npCph1 | ------------------------------------------------------------ |
| cwCph1a | ------------------------------------------------------------ |
| npCph1a | ------------------------------------------------------------ |
| toCphA | ------------------------------------------------------------ |
| aphB | ------------------------------------------------------------ |
| atBphP1 | ------------------------------------------------------------ |
| atBphP3 | ------------------------------------------------------------ |

-continued

| Name/ SEQ ID No | Sequence |
|---|---|
| avAphB | ------------------------------------------------------------ |
| chBphP1 | ------------------------------------------------------------ |
| chBphP2 | ------------------------------------------------------------ |
| drbphp | ------------------------------------------------------------ |
| goBphP | ------------------------------------------------------------ |
| krBphP | ------------------------------------------------------------ |
| mmBphP2 | ------------------------------------------------------------ |
| paBphP | ------------------------------------------------------------ |
| pfBphP | ------------------------------------------------------------ |
| ppBphP1 | ------------------------------------------------------------ |
| ppBphP2 | ------------------------------------------------------------ |
| ppkBphP2 | ------------------------------------------------------------ |
| psBphP1 | ------------------------------------------------------------ |
| psBphP2 | ------------------------------------------------------------ |
| pssBphP1 | ------------------------------------------------------------ |
| pssBphP2 | ------------------------------------------------------------ |
| pstBphP1 | ------------------------------------------------------------ |
| rcPpr | ------------------------------------------------------------ |
| rlBphP | ------------------------------------------------------------ |
| atBphP2 | ------------------------------------------------------------ |
| brBphP | ------------------------------------------------------------ |
| rpBphP1N | ------------------------------------------------------------ |
| rpBphP2N | ------------------------------------------------------------ |
| rpBphP3N | ------------------------------------------------------------ |
| rpBphP4N | ------------------------------------------------------------ |
| rpBphP5N | ------------------------------------------------------------ |
| rpBphP6N | ------------------------------------------------------------ |
| rrBphP | ------------------------------------------------------------ |
| rsBphP1 | ------------------------------------------------------------ |
| rsBphP1a | ------------------------------------------------------------ |
| toCphB | ------------------------------------------------------------ |
| xaBphP | ------------------------------------------------------------ |
| xcBphP | ------------------------------------------------------------ |
| anFPH1 | ------------------------------------------------------------ |
| bfFPH2 | ------------------------------------------------------------ |
| chFPH1 | ------------------------------------------------------------ |
| cnFPH1 | ------------------------------------------------------------ |
| gmFPH1 | ------------------------------------------------------------ |

-continued

| Name/ SEQ ID No | Sequence |
|---|---|
| gzFPH1 | ------------------------------------------------------------------------ |
| ncFPH1 | ------------------------------------------------------------------------ |
| ncFPH2 | ------------------------------------------------------------------------ |
| umFPH1 | ------------------------------------------------------------------------ |
| aphC | ------------------------------------------------------------------------ |
| cph2 | ------------------------------------------------------------------------ |
| npCph2a1 | ------------------------------------------------------------------------ |
| npCph2a2 | ------------------------------------------------------------------------ |
| npCph2b | ------------------------------------------------------------------------ |
| arphyA | --------------------------- |
| asphya3 | --------------------------- |
| asphya4 | --------------------------- |
| atphya | --------------------------- |
| cpphya | --------------------------- |
| cupphya | --------------------------- |
| gmphya | --------------------------- |
| lephya | --------------------------- |
| lsphya | --------------------------- |
| mgphya | --------------------------- |
| ntphya | --------------------------- |
| omphya | --------------------------- |
| osphya | --------------------------- |
| pcphya | --------------------------- |
| psphya | --------------------------- |
| sbphya | --------------------------- |
| slphya1 | --------------------------- |
| slphya3 | --------------------------- |
| slphya4 | --------------------------- |
| stphya | --------------------------- |
| taphya | --------------------------- |
| zmphya1 | --------------------------- |
| atphyb | --------------------------- |
| atphyd | --------------------------- |
| gmphyb | --------------------------- |
| lephb1 | --------------------------- |
| lephb2 | --------------------------- |
| npphyB | --------------------------- |
| ntphyb | --------------------------- |
| osphyb | --------------------------- |

-continued

| Name/ SEQ ID No | Sequence |
| --- | --- |
| pbphyb1 | --------------------------- |
| pbphyb2 | --------------------------- |
| sbphyB | --------------------------- |
| slphyb | --------------------------- |
| stphyb1 | --------------------------- |
| stphyb2 | --------------------------- |
| zmphyb1 | --------------------------- |
| zmphyb2 | --------------------------- |
| atphyc | --------------------------- |
| osphyc | --------------------------- |
| sbphyc | --------------------------- |
| slphyc | --------------------------- |
| taphyc | --------------------------- |
| zmphyc1 | --------------------------- |
| zmphyc2 | --------------------------- |
| lephye | --------------------------- |
| atphye | --------------------------- |
| inphye | --------------------------- |
| lephyf | --------------------------- |
| acvphy1 | --------------------------- |
| acvphy2 | --------------------------- |
| acvphy3 | --------------------------- |
| apphy1 | --------------------------- |
| cpphy2 | --------------------------- |
| mcphy1 | --------------------------- |
| mpphy1 | --------------------------- |
| msphy1 | --------------------------- |
| paphy1 | --------------------------- |
| ppphy0 | --------------------------- |
| ppphy1 | --------------------------- |
| ppphy2 | --------------------------- |
| ppphy3 | --------------------------- |
| ppphy4 | --------------------------- |
| psphy1 | --------------------------- |
| smphy1 | --------------------------- |
| aphA | --------------------------- |
| cph1 | --------------------------- |
| cwCph1 | --------------------------- |

-continued

| Name/ SEQ ID No | Sequence |
|---|---|
| npCph1 | --------------------------- |
| cwCph1a | --------------------------- |
| npCph1a | --------------------------- |
| toCphA | --------------------------- |
| aphB | --------------------------- |
| atBphP1 | --------------------------- |
| atBphP3 | --------------------------- |
| avAphB | --------------------------- |
| chBphP1 | --------------------------- |
| chBphP2 | --------------------------- |
| drbphp | --------------------------- |
| goBphP | --------------------------- |
| krBphP | --------------------------- |
| mmBphP2 | --------------------------- |
| paBphP | --------------------------- |
| pfBphP | --------------------------- |
| ppBphP1 | --------------------------- |
| ppBphP2 | --------------------------- |
| ppkBphP2 | --------------------------- |
| psBphP1 | --------------------------- |
| psBphP2 | --------------------------- |
| pssBphP1 | --------------------------- |
| pssBphP2 | --------------------------- |
| pstBphP1 | --------------------------- |
| rcPpr | --------------------------- |
| rlBphP | --------------------------- |
| atBphP2 | --------------------------- |
| brBphP | --------------------------- |
| rpBphP1N | --------------------------- |
| rpBphP2N | --------------------------- |
| rpBphP3N | --------------------------- |
| rpBphP4N | --------------------------- |
| rpBphP5N | --------------------------- |
| rpBphP6N | --------------------------- |
| rrBphP | --------------------------- |
| rsBphP1 | --------------------------- |
| rsBphP1a | --------------------------- |
| toCphB | --------------------------- |
| xaBphP | --------------------------- |

-continued

| Name/ SEQ ID No | Sequence |
|---|---|
| xcBphP | -------------------------- |
| anFPH1 | -------------------------- |
| bfFPH2 | -------------------------- |
| chFPH1 | -------------------------- |
| cnFPH1 | -------------------------- |
| gmFPH1 | -------------------------- |
| gzFPH1 | -------------------------- |
| ncFPH1 | -------------------------- |
| ncFPH2 | -------------------------- |
| umFPH1 | -------------------------- |
| aphC | -------------------------- |
| cph2 | -------------------------- |
| npCph2a1 | -------------------------- |
| npCph2a2 | -------------------------- |
| npCph2b | -------------------------- |

EXAMPLES

The following examples are offered to illustrate, but not to limit the claimed invention.

Example 1

Production of Transgenic Plants Comprising a Mutant Phytochrome and Showing Altered Photomorphogenesis This example describes the unexpected discovery of a mutation in plant phytochromes that confers 'light-independent' activation. This gain-of-function activity is caused by mutation of a conserved tyrosine residue critical for phytochrome photoactivation (Fischer and Lagarias (2004) *Proc. Natl. Acad. Sci. USA* 101: 17334-17339; Fischer et al. (2005) *Biochem.* 44: 15203-15215). Since mutagenesis of this tyrosine inhibits the efficiency of the Pr to Pfr photoconversion, we expected that these mutants would exhibit reduced light-signaling activity. Contrary to this hypothesis, we observe that expression of an *Arabidopsis* phytochrome B allele encoding the fluorescent $Tyr_{276}$His mutation, i.e. AtPHYB($Y_{276}$H), not only complements light-grown phyB mutants as well as the wild type allele, but also effects 'light-independent' photomorphogenesis. This phenotype is observed whether the AtPHYB($Y_{276}$H) transgene was regulated by its own promoter or by a strong constitutive viral promoter. Unlike phyB mutant plants complemented with the wild type AtPHYB allele, dark grown plants expressing AtPHYB($Y_{276}$H) develop "as if they were grown in light", exhibiting reduced hypocotyl elongation and development of expanded cotyledons and leaves. AtPHYB($Y_{276}$H) transgenic plants continue to develop in darkness, and ultimately flower if sucrose is present in the growth medium. The constitutive photomorphogenetic phenotype of AtPHYB($Y_{276}$H) expression is observed in wild type, phyB and phyA/phyB mutant genetic backgrounds, indicating that this gain-of-function activity is dominant. RT PCR measurements reveal that representative genes normally requiring light for expression were active in dark-grown AtPHYB($Y_{276}$H) transgenic plants. Consistent with the light-independent nuclear localization of the AtphyB($Y_{276}$H) polypeptide measured by fluorescence microscopy, our results indicate that the $Y_{276}$H phyB protein adopts a 'light-activated' Pfr-like conformation to initiate photomorphogenesis in a light-independent manner. The constitutive photomorphogenesis conferred by AtPHYB ($Y_{276}$H) expression depends upon phytobilin biosynthesis, hence the 'activated' conformation of the AtphyB($Y_{276}$H) protein appears to require the presence of a bound chromophore. Comparative phenotypic analysis of transgenic plants expressing AtPHYB($Y_{276}$Q), AtPHYB($Y_{276}$I) and AtPHYB($Y_{276}$R) alleles reveal that the fluorescent $Y_{276}$Q mutation also confers partial light-independent photomorphogenesis, while the non-fluorescent $Y_{276}$I and $Y_{276}$R alleles do not. Under continuous red (Rc) however, $Y_{276}$I partially complements the phyB mutant suggesting that this mutant retains residual phyB photoactivity. These results are supported by co-expression of recombinant AtphyB($Y_{276}$X) alleles with bilin chromophore that indicates that all but the AtPHYB($Y_{276}$R) apoprotein are capable of chromophore binding. In contrast with AtphyB($Y_{276}$H) experiments, expression of the corresponding YH allele of *Arabidopsis* phytochrome A, i.e. AtPHYA($Y_{242}$H), incompletely complements the phyA mutant under FRc and poorly effects dark photomorphogenesis. AtPHYA($Y_{242}$H) expression in wild type backgrounds does however confer a dominant-negative phenotype under FRc. These results implicate heterodimerization of AtphyA($Y_{242}$H) with wild type AtphyA or its interference with downstream components to inhibit signal transfer. In view of the biological activity of YX alleles of phyA and phyB in transgenic plants, we conclude that expression of YX alleles of phytochromes in any transformable plant species will provide an effective means to regulate photomorphogenesis, eg. reducing yield losses due to shade avoidance responses, enhancing seed germination in low light, modifying the timing of flowering and even propagation of plant germplasm in darkness.

Methods.

Plant Transformation Constructs.

The *Arabidopsis* PHYA coding region was amplified with Pfu polymerase using the primers AtPHYA-SacI-F, 5'-AGA GCT CAT GTC AGG CTC TAG GCC GACT-3' (SEQ ID NO:123) and AtPHYA-SalI-R, 5'-CTA GTC GAC CTA CTT GTT TGC TGC AGC GAG TTC-3' (SEQ ID NO:124) and the AtPHYA cDNA-containing plasmid pA2a, a kind gift of Joanne Chory (Salk Institute, La Jolla, Calif.), as the DNA template. The resulting PCR product was blunt-end cloned into pBluescript II KS+ restricted with EcoRV to yield pBS-AtPHYA$^c$. Plasmid pBS-AtPHYA$^c$YH was generated by PCR mutagenesis using the QuikChange Site-Directed Mutagenesis Kit (Stratagene, La Jolla, Calif.) with primers AtPHYA(YH)-F, 5'-GGT ATG ACA GGG TGA TGG CT CATA AGT TTC ATG AAG ATG ATC AC-3' (SEQ ID NO:125) and AtPHYA(YH)-R, 5'-GTG ATC ATC TTC ATG AAA CTT ATGAGC CAT CAC CCT GTC ATA CC-3' (SEQ ID NO:126) with plasmid pBS-AtPHYA$^c$ as template. In order to express AtPHYA$^c$(YH) under the control of cauliflower mosaic viral (CaMV) 35S promoter, the AtPHYA$^c$(YH) region was excised with SacI and SalI and from pBS-AtPHYA$^c$YH and cloned into similarly restricted pCHF1 to produce pCHP1-AtPHYA$^c$YH. In order to express AtPHYA and AtPHYA(YH) coding regions under the control of *Arabidopsis* PHYA promoter (5'AtPHYA), the *Arabidopsis* PHYA promoter was amplified with Pfu polymerase using primers 5'AtPHYA-EcoRI-F, 5'-GGA ATT CGA ATT GCG CTG TCT AGA TAA GA-3' (SEQ ID NO:127) and 5'AtPHYA-BamHI-SacI-R, 5'-AGA GCT CGG ATC CCC TTT TTC CTG ACA CAG AGA C-3' (SEQ ID NO:128) and Col genomic DNA as template. The PCR product was blunt-end cloned into pBluescript II KS+restricted with EcoRV to yield pBS-5'AtPHYA. The AtPHYA$^c$ coding region was restricted from pBS-AtPHYA$^c$ with SacI and SalI and the 5AtPHYA promoter region was restricted from pBS-5'AtPHYA with EcoRI and SacI. The two fragments were ligated into EcoRI- and SalI-restricted pCHF1 (Neff et al. (1999) *Proc. Nat. Acad. Sci. USA* 96: 15316-15323) to yield pCHF1-5'AtPHYA::AtPHYA$^c$. An analogous strategy was used to generate pCHF1-5'AtPHYA::AtPHYA$^c$(YH). The AtPHYB cDNA plant transformation vector pJM61 was that described previously (Maloof et al. (2001) *Nat Genet* 29: 441-446). Construction of the AtPHYB$^c$(YH) plant transformation vector entailed two cloning steps. The pBS-AtPHYB$^c$(YH)-ST plasmid was initially constructed by mutagenizing the plasmid pBS-AtPHYB$^c$-ST (Fischer et al. (2005) *Biochem.* 44: 15203-15215) using primers AtPHYB(YH)-F, 5'-GGT TAT GAT CGT GTT ATG GTT CAT AAG TTT CAT GAA GAT GAG C-3' (SEQ ID NO:129) and AtPHYB(YH)-R, 5'-GCT CAT CTT CAT GAA ACT TAT GAA CCA TAA CAC GAT CAT AAC C-3' (SEQ ID NO:130). The mutagenized region was excised with BamHI and SpeI restriction enzymes and cloned into the similarly restricted AtPHYB(WT)-containing plant transformation vector pJM61 to generate pJM61(YH). To generate AtPHYB$^g$(YH), AtPHYB$^g$(YI), AtPHYB$^g$(YQ) and AtPHYB$^g$(YR) genomic plant transformation vectors, the AtPHYB genomic DNA-containing plasmid pJM78, which was kindly provided by Dr. Julin Maloof (University of California, Davis), was used for site directed mutagenesis using the following primer sets: AtPHYB(YH)-F and AtPHYB(YH)-R (see above). AtPHYB(YI)-F: 5'-GGT TAT GAT CGT GTT ATG GTT ATT AAG TTT CAT GAA GAT GAG C-3' (SEQ ID NO:131) and AtPHYB(YI)-R: 5'-GCT CAT CTT CAT GAA ACT TAATAA CCA TAA CAC GAT CAT AAC C-3' (SEQ ID NO:132). AtPHYB(YQ)-F: 5'-GTT ATG ATC GTG TTA TGG TTCAAA AGT TTC ATG AAG ATG AGC-3' (SEQ ID NO:133) and AtPHYB(YQ)-R: 5'-GCT CAT CTT CAT GAA ACT TTT GAA CCA TAA CAC GAT CAT AAC-3' (SEQ ID NO:134). AtPHYB(YR)-F: 5'-TTA TGA TCG TGT TAT GGT TCGTAA GTT TCA TGA AGA TGA GC-3' (SEQ ID NO:135) and AtPHYB(YR)-R: 5'-GCT CAT CTT CAT GAA ACT TACGAA CCA TAA CAC GAT CAT AA-3' (SEQ ID NO:136). The mutagenized region was excised with SacII and PstI and cloned into the similarly restricted AtPHYB genomic DNA-containing plant transformation vector pJM63 (kindly provided by Drs. Joanne Chory and Julin Maloof) to generate pJM63(YH), pJM63(YI), pJM63(YQ) and pJM63(YR) (see, FIG. 1 for maps of plasmid T-DNA inserts.

Plant Transformation, Selection and Phenotypic Analysis.

*Arabidopsis* ecotype Landsberg erecta (Ler) wild type, phyA-201, phyB-5, phyA-201phyB-5 double mutant and hy1-1phyA-201phyB-1 triple mutant were transformed with the floral dip technique using *Agrobacterium tumefaciens* strain GV3101 as the host (Clough and Bent (1998) *Plant J.* 16: 735-743). Transgenic plants were selected on solid media containing half-strength Mirashige-Skoog salt, half-strength vitamin solution, 1% w/v sucrose and 0.8% w/v agar (Phytoblend, Caisson Laboratories, Inc, Rexburg, Id., Cat. No. PTC001) with gentamycin (100 μg/ml, for pCHF1-based AtPHYA constructs) or kanamycin (35 μg/ml, for pJM61 (WT & YH) and pJM63 (WT, YH, YI, YQ & YR) AtPHYB constructs). T3 homozygous lines were obtained and seedlings from the T3 or T4 generation were used for photographs, protein extraction and phenotypic analyses. The 35S::AtPHYB-GFP expressing line PBG-5 in the phyB-5 mutant background (Yamaguchi et al. (1999) *J. Cell Biol.* 145: 437-445), a generous gift of Dr. Akira Nagatani, was used as a control for fluorescence microscopy. For growth on solid media, seeds were first rinsed with 95% EtOH for 1 min, surface-sterilized with 33% v/v commercial bleach solution containing 0.02% w/v SDS for 15 min and rinsed with sterile $H_2O$ five times before sowing on solid media. Plates were kept in dark at 4° C. for 2 days, exposed to white light at 20° C. for 2-4 h prior to moving to desired light conditions. For hypocotyl measurements, seeds were surface-sterilized and planted on solid media containing 1× Mirashige-Skoog salt, 1× vitamin solution and 0.8% w/v agar. For data presented in FIGS. 2-5, solid media was supplemented with 1% w/v sucrose. Plates were kept in dark at 4° C. for 2 days, exposed to white light at 20° C. for 2 h prior to growth at 20° C. under the desired light conditions. SNAP-LITE (Quantum Devices, Inc., Barneveld, Wis.) were used as light sources for red (662+/−15 nm) and far red light (730+/−15 nm) with a fluence rate of 20 μmole $m^{-2}$ $s^{-1}$. For seedlings grown under white light, Philips F48T12 cool white VHO 1LP fluorescent lights were used with a fluence rate of 80-100 μmole $m^{-2}$ $s^{-1}$. All seedlings were grown at 20° C. and six-day-old seedlings were used for hypocotyl length measurement. For quantitative analyses, the average hypocotyl length measurements (+/−SD) of fifty seedlings were determined.

Total Plant Protein Extraction and Immunoblot Analysis

For total protein extraction, six-day-old dark grown seedlings were frozen in liquid nitrogen, ground into powder and extracted with hot-SDS buffer (165 mM Tris-HCl, pH 6.8, 5.1% w/v SDS, 5 mM EDTA, 5 mM EGTA, 5% β-mercaptoethanol, 1 mM PMSF) then boiling for 1 min. Soluble fraction was clarified by centrifugation and proteins were precipitated by methanol chloroform extraction (Wessel and Flugge (1984) *Anal. Biochem.* 138: 141-143). Protein pellets were dissolved in 50 mM Tris-HCl, pH 6.8 with 2% SDS and protein concentration was determined by BCA assay (Pierce, Rockford, Ill.). Equal amount of proteins were separated on Tris-Glycine SDS-PAGE and transferred to PVDF membrane. Monoclonal anti-PHYA 073D, anti-PHYB B6-B3 (both are kindly provided by Dr. Peter Quail, University of California, Berkeley) and monoclonal anti-α-tubulin (Sigma, T9026) antibodies were used for probing AtPHYA, AtPHYB and tubulin. After washing, blots were incubated with alkaline phosphatase-conjugated goat anti-mouse IgG (Santa Cruz Biotechnology, Inc. Santa Cruz, Calif.). Bands were visualized by incubating blots with NBT/BCIP reagent (Pierce, Rockford, Ill.).

RT PCR Analysis.

Total RNA was isolated from seven-day-old dark- and light-grown seedlings using TRIzol regent (Invitrogen, Carlsbad, Calif.). First strand cDNA was synthesized using StrataScript First-Strand Synthesis System (Stratagene, La Jolla, Calif.) and 1 μL of first strand cDNA was used for 25 μL PCR reaction. CAB1, CHS and actin genes were amplified using the following primer sets. CAB1-F: 5'-TAA GGC CGT CAA GCT TTC CCC-3' (SEQ ID NO:137) and CAB1-R: 5'-TAC CAT GGG CTG CCT GAT GG-3' (SEQ ID NO:138). CHS-F: 5'-TAA GGC CGT CAA GCT TTC CCC-3' (SEQ ID NO:139) and CHS-R: 5'-TAC CAT GGG CTG CCT GAT GG-3' (SEQ ID NO:140). Actin-F: 5'-ATG AAG ATT AAG GTC GTG GCA-3' (SEQ ID NO:141) and actin-R: 5'-GAG TTT GAA GAG GCT AC-3'(SEQ ID NO:142). PCR reactions were performed using the following cycle: 94° C., 2 min, 94° C., 30 sec, 56° C., 30 sec and 72° C. 40 sec for 35 cycles and 72° C., 10 min. 10 μL of PCR reaction was separated on 2% TAE gel and visualized with ethidium bromide staining.

Fluorescence Microscopy for Phytochrome Localization.

Representative five-day-old dark and light grown (continuous white light, 80 μmole $m^{-2}$ $sec^{-1}$) transgenic plant lines were first stained with 50 ng/mL DAPI in PBS buffer for 30 min then destain in PBS buffer for 10 min or directly transferred to a microscope slide immersed in PBS buffer under a cover slip prior to examination by fluorescence microscopy at the MCB Microscopy Imaging Facility. For data shown in FIG. 12 (panel A), an API DeltaVision Deconvolution Microscope (RT-QLM) equipped with DAPI (EX360/40, EM457/50), FITC (EX490/20, EM528/38) and CY-5 (EX640/20, EM685/40) filter sets were used to visualize DNA, GFP and phyB(YH), respectively. For data shown in FIG. 12 (panel B), an Olympus FV1000 Laser Scanning Confocal Microscope equipped with LD violet diode laser (405 nm, 25 mW), Multi-line Ar laser (457 nm, 488 nm, 515 nm, Total 30 mW), a HeNe-G laser (543 nm, 1 mW) and a HeNe—R laser (633 nm, 10 mW) using DAPI, GFP and CY-5 settings were used to visualize DNA, GFP and phyB(YH), respectively.

Recombinant Phytochrome Expression and Purification.

Competent cells of *E. coli* strain LMG194 (Invitrogen) and *E. coli* strain LMG194 containing plasmid pPL-PCB (LMG194:pPL-PCB) were transformed with pBAD-Cph1FL-myc-his or pBAD-AtPhyB(N450)-6×his plasmids (Fischer et al. (2005) *Biochem.* 44; 15203-15215) using standard protocols. The YH, YQ, YI and YR mutations were introduced into the latter clone by site-directed mutagenesis using the primers described above. For in vivo assembled (holo)phytochromes, dual ampicillin- and kanamycin-resistant transformants of LMG194:pPL-PCB were cultured overnight at 37° C. in 2 ml of RM liquid media containing 50 μg/ml of ampicillin and 25 μg/ml of kanamycin (RM/AK). Following 1:250 dilution into 100 ml of RM/AK, cells were grown at 37° C. to an $OD_{580}$ of ≈0.5. The 100 ml cultures were then diluted with 900 ml of LB medium containing 50 μg/ml of ampicillin and 25 μg/ml of kanamycin (LB/AK). Isopropyl β-D-thiogalactoside (IPTG) was added to a final concentration of 0.5 mM to induce expression of the bilin biosynthetic operon. After incubation for 1 h at 37° C., L-arabinose was added to a final concentration of 0.002% (w/v) to induce the expression of the apophytochrome and to hyper-induce the bilin biosynthetic operon. Cell cultures were grown at 37° C. for 4 h, after which cells were collected by centrifugation and resuspended in 5 ml of extraction/wash (EW) buffer (50 mM Tris-HCl pH 7.0, 300 mM NaCl, 1 mM 2-mercaptoethanol, and 20 mM imidazole). Cell suspensions were passed through a French press twice at 10,000 psi to lyse the cells, and insoluble material was removed by ultracentrifugation at 75,000 rpm for 20 min (TLA 100.2 rotor). Recombinant phytochromes were then purified from the crude soluble protein extract using TALON spin columns that contain 0.5 ml bed volume of TALON-NX metal affinity resin (Clontech Laboratories). Crude soluble protein extracts were applied to TALON spin columns that had been pre-equilibrated with EW buffer. Following washing with EW buffer (2×column volume), bound protein was eluted with EW buffer containing 200 mM imidazole adjusted to pH 7.0. Prior to spectrophotometric analysis, purified Cph1 and AtphyB solutions were dialyzed overnight at 4° C. against 25 mM TES KOH pH 7.5 containing 10% (v/v) glycerol. Apophytochromes were isolated similarly except that kanamycin and IPTG were not included in the growth media. All expressions and purifications were carried out in the dark or under green light to reduce phytochrome photoconversion.

Limited Proteolysis of Cph1.

Recombinant full-length Cph1 WT and YH holoproteins were purified using IMPACT-CN system (NEB, Ipswich, Mass.). To convert to the Pfr or Pr form, protein solutions (1.5 mg/mL) were irradiated with saturating red light (650+/−5 nm) or far red light (720+/−5 nm). Proteolysis was initiated by adding trypsin (Sigma, St. Louis, Mo.) to final concentration of 5 μg/mL. Samples were collected after 2.5, 5, 15, 30 and 60 min incubation at room temperature. Hot 2×SDS sample buffer was added to inactivate trypsin and the samples were further heated at 95° C. for 5 min. Proteins (3 μg per lane) were separated on 12% Tris-Glycine SDS-PAGE and stained with Coomassie blue (Sigma, St. Louis, Mo.) to visualize proteolytic fragments (Laemmli (1970) *Nature* 227: 680-685).

Absorption and Fluorescence Measurements.

All absorption spectra were obtained using an HP8453 ultraviolet-visible spectrophotometer. Phytochrome difference spectra were obtained as described previously (Terry and Lagarias (1991) *J. Biol. Chem.* 266:22215-22221). Red light (650+/−5 nm) and far red light (720+/−5 nm) used for difference spectroscopy had fluence rates of 150 μmol $m^{-2}$ $s^{-1}$. Corrected fluorescence excitation and emission spectra were obtained with an SLM Aminco Bowman AB2 fluorimeter. Monochromators were adjusted to 4 nm bandpass for all fluorescence measurements on the AB2. For comparative purposes, fluorescence measurements shown on the same graphs were performed using samples adjusted to equal absorbance at 280 nm (0.4) and equal excitation voltages were used.

SDS-PAGE and Zinc-Blot Analysis.

Protein samples were analyzed by SDS-PAGE using the Laemmli buffer system (Laemmli (1970) *Nature* 227: 680-685). After electrophoresis, proteins were electrophoretically transferred to polyvinylidene difluoride (PVDF) membranes at 100 V for 60 minutes. The PVDF membranes were incubated in 1.3 M zinc acetate overnight at 4° C., and the fluorescence was detected using a Storm 860 Fluorimager in red fluorescence mode (Berkelman: T. R.: and Lagarias: J. C. (1986) *Anal. Biochem.* 156: 194-201; Li and Lagarias (1992) *J. Biol. Chem.* 267: 19204-19210).

Results & Discussion.

Construction of Transgenic Plant Lines.

To investigate the biological activity of the YH mutant of *Arabidopsis* phyA and phyB, the plant transformation vectors shown in FIG. 1 were constructed. For expression of AtPHYB WT and YH cDNAs under control of the CaMV 35S promoter, we transformed wild type Ler, phyB-5, phyA-201phyB-5 and hy1-1phyA-201phyB-1 lines. Wild type and YH mutant AtPHYB genes were used to transform phyA-201phyB-5 and hy1-1phyA-201phyB-1 mutants. For phenotypic comparison, transgenic plants expressing the YI, YQ and YR mutant AtPHYB genes in the phyA-201phyB-5 double mutant background were also prepared. In addition to the AtPHYB transgenic lines, WT and YH mutant AtPHYA cDNAs under control of the AtPHYA promoter were expressed in wild type Ler and the phyA-201 mutant backgrounds. Transgenic plant lines expressing the AtPHYA YH mutant cDNA under control of the CaMV 35S promoter were also constructed for comparison with lines expressing AtPHYA WT cDNA. In all cases, multiple transformant lines were selected (typically more than 5), from which the homozygous, single insertion T3 lines shown in Table 2 were obtained.

TABLE 2

Transgenic plant lines expressing wild type and YX mutant phytochromes

| | Number of 1° Transformants | Number of homozygous T3 lines | Phenotype Dark | FRc | Rc |
|---|---|---|---|---|---|
| PHYB Construct/Genotype Transformed | | | | | |
| 35S::AtPHYB$^{c}$/Ler | 34 (10)[a] | 1 (#1)[b] | WT | N.D. | WT+ |
| 35S::AtPHYB$^{c}$/phyB-5 | 21 (15) | 4 (#7, #8, #9, #11) | WT | N.D. | WT+ |
| 35S::AtPHYB$^{c}$/phyA-201phyB-5 | 26 (8) | 1 (#2) | WT | phyA[d] | WT+ |
| 35S::AtPHYB$^{c}$/phyA-201phyB-1hy1-1 | 5 (5) | 2 (#4, #5) | WT | N.D.[e] | (WT)* |
| 35S::AtPHYB$^{c}$YH/Ler | 10 (10) | 2 (#3, #4) | cop[c] | N.D. | WT+ |
| 35S::AtPHYB$^{c}$YH/phyB-5 | 20 (18) | 2 (#10, #16) | cop | N.D. | WT+ |
| 35S::AtPHYB$^{c}$YH/phyA-201phyB-5 | 45 (8) | 2 (#1, #3) | cop | WT | WT+ |
| 35S::AtPHYB$^{c}$YH/phyA-201phyB-1hy1-1 | 11 (11) | 3 (#1, #6, #7) | (cop)* | N.D. | WT |
| AtPHYB$^{g}$/phyA-201phyB-5 | 53 (16) | 4 (#9, #10, #14, #16) | WT | phyA | WT+ |
| AtPHYB$^{g}$/phyA-201phyB-1hy1-1 | 10 (10) | 3 (#1, #4, #6) | WT | N.D. | (WT)* |
| AtPHYB$^{g}$YH/phyA-201phyB-5 | 38 (8) | 2 (#4, #5) | cop | WT | WT+ |
| AtPHYB$^{g}$YQ/phyA-201phyB-5 | 51 (16) | 7 (#1, #4, #5, #7, #8, #12, #14) | (cop)* | WT | WT+ |
| AtPHYB$^{g}$YI/phyA-201phyB-5 | 77 (22) | 6 (#1, #2, #3, #6, #9, #10) | WT | phyA | WT |
| AtPHYB$^{g}$YR/phyA-201phyB-5 | 43 (16) | 7 (#1, #3, #6, #8, #10, #11, #13) | WT | phyA | phyB[f] |
| AtPHYB$^{g}$YH/phyA-201phyB-1hy1-1 | 13 (13) | 6 (#1, #5, #6, #7, #9, #10) | (cop)* | N.D. | WT |
| PHYA Construct/Genotype Transformed | | | | | |
| 5'AtPHYA::AtPHYA$^{c}$/Ler | 5 (5) | 2 (#3, #4) | WT | WT+ | N.D. |
| 5'AtPHYA::AtPHYA$^{c}$YH/Ler | 5 (5) | 2 (#1, #4) | WT+ | (WT)* | N.D. |
| 5'AtPHYA::AtPHYA$^{c}$/phy-A201 | 5 (5) | 1 (#3) | WT | WT | N.D. |
| 5'AtPHYA::AtPHYA$^{c}$YH/phy-A201 | 9 (9) | 3 (#3, #5, #8) | WT+ | (phyA)+ | N.D. |
| 35S::AtPHYA$^{c}$YH/phyA-201 | 2 (2) | 2 (#1, #2) | WT | phyA | N.D. |

*partially active

+more active

[a]number of individual T1 lines have been used for segregation analysis in T2 progeny.

[b]line serial number.

[c]constitutive photomorphogenesis.

[d]phyA phenotype, elongated hypocotyl under continuous far red light.

[e]not determined.

[f]phyB phenotype, elongated hypocotyl under continuous red light

Expression of AtPHYB(YH) Fully Rescues the phyB Null Phenotype, while AtPHYA(YH) Expression Fails to Rescue the phyA Null Phenotype.

Figure 2:
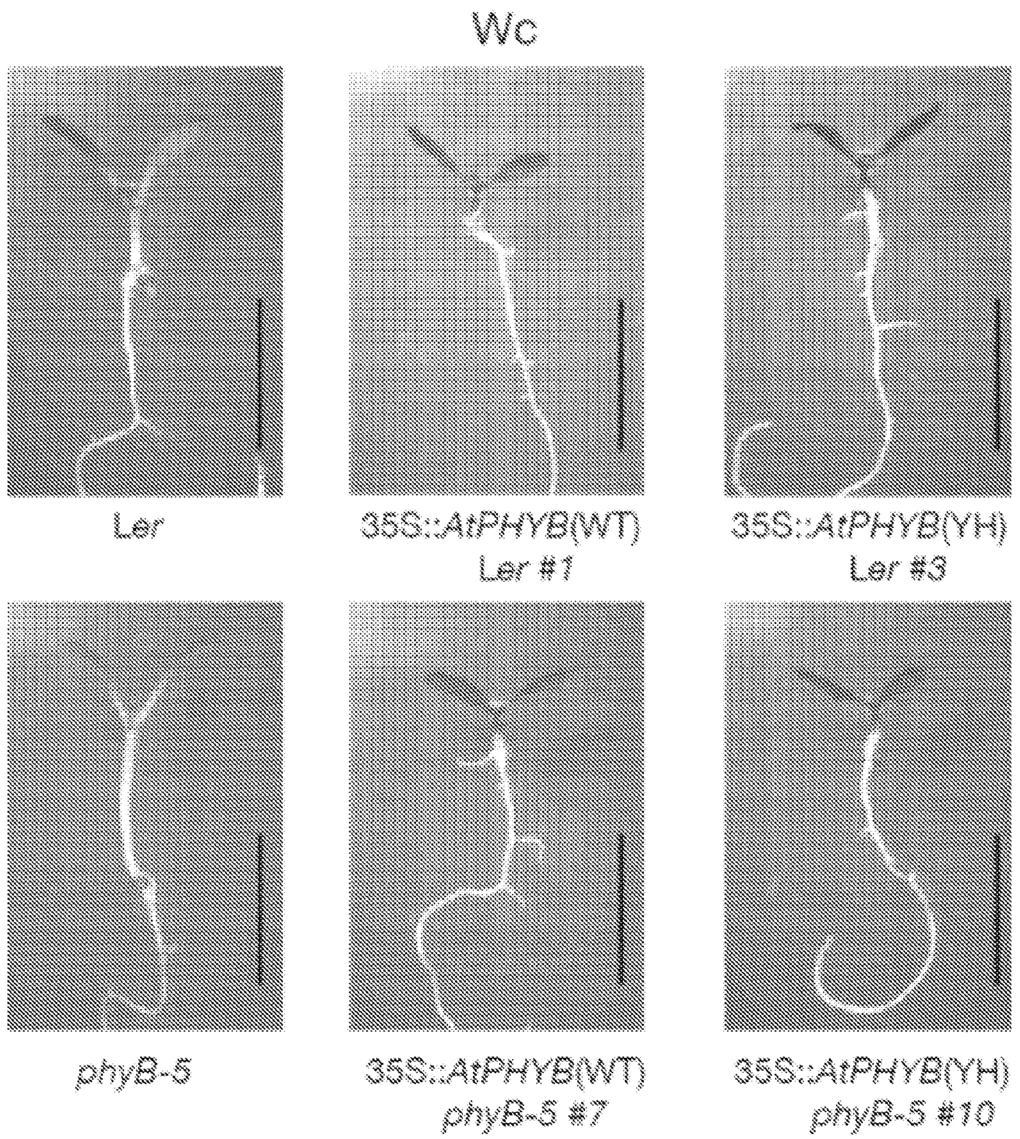
FIG. 2 (6 panels) shows the seedling phenotype of continuous white (Wc) light-grown parent lines and AtPHYB(WT)- and AtPHYB(YH)-expressing transgenic plants on sucrose-containing agar media. Six day-old seedlings grown in continuous white light (80 μmol $m^{-2}$ $sec^{-1}$) on 0.5× Mirashige-Skoog medium supplied with 1% sucrose are shown. Top panels show wild type Ler and representative AtPHYB(WT) and AtPHYB(YH) transgenic lines in the Ler background. Bottom panels show phyB-5 mutant and representative AtPHYB(WT) and AtPHYB(YH) transgenic lines in the phyB-5 mutant background. The scale bar indicates 5 mm length and promoters are those indicated in FIG. 1.
Figure 3:
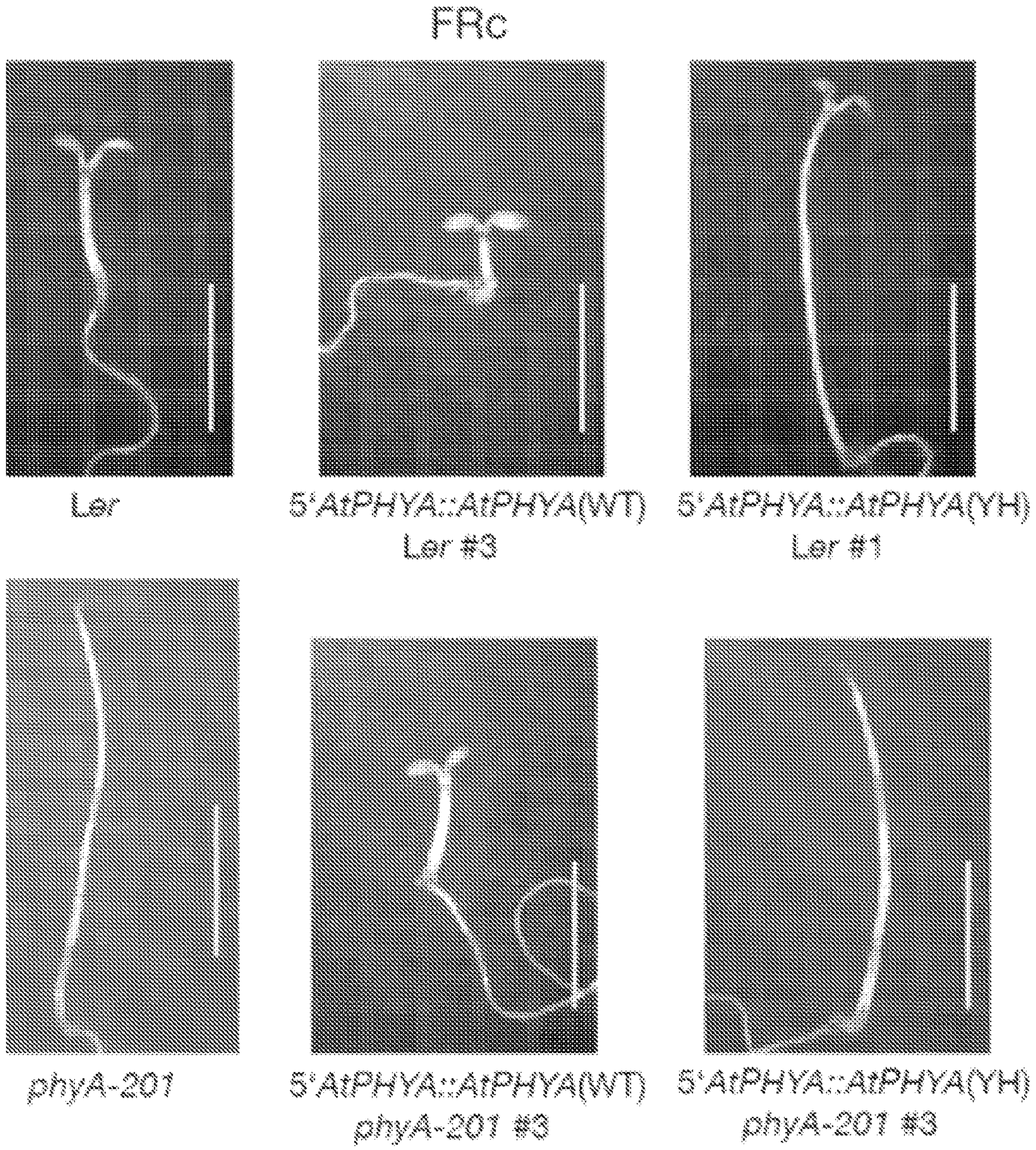
FIG. 3 (6 panels) shows the seedling phenotype of continuous far red (FRc) light-grown parent lines and AtPHYA(WT)- and AtPHYA(YH)-expressing transgenic lines on sucrose-containing agar media. Six day-old seedlings grown in continuous far red (FRc) light (20 μmol $m^{-2}$ $sec^{-1}$) on 0.5× Mirashige-Skoog medium supplied with 1% sucrose are shown. Top panels show wild type Ler and representative AtPHYB(WT) and AtPHYB(YH) transgenic lines in the Ler background. Bottom panels show phyA-201 mutant and representative AtPHYA(WT) and AtPHYA(YH) transgenic lines in the phyA-201 mutant background. The scale bar indicates 5 mm length and promoters are those indicated in FIG. 1.

It is well established that expression of WT AtPHYB rescues impaired photomorphogenesis of phyB mutants (Hirschfeld et al. (1998) *Genetics* 149: 523-535; Wester et al. (1994) *Plant J.* 5: 261-272), while WT AtPHYB overexpression in wild type backgrounds confers light-exaggerated phenotypes (Wagner et al. (1991) *Plant Cell* 3: 1275-1288). As shown in FIG. 2, expression of both WT and YH AtPHYB cDNAs under control of the CaMV 35S promoter rescue the elongated hypocotyl phenotype of the phyB mutant grown in continuous white (Wc) light at a fluence rate of 80 $\mu mol^{-1}$ $m^{-2}$ $s^{-1}$. Overexpression of AtPHYB(YH) in Ler wild type also confers a light-exaggerated phenotype similar to WT transgenics in which hypocotyls are considerably shorter than the untransformed parent. These results indicate that the YH allele of AtPHYB is biologically active in light-grown plants. By contrast with phyB mutants that are deficient in the R/FR reversible LFR responses, phyA mutants are deficient in FR HIR and VLFR responses, and thus poorly respond to FR (Shinomura et al. (1996) *Proc. Natl. Acad. Sci. USA* 93: 8129-8133). Conversely, PHYA-overexpressing transgenic plants exhibit enhanced FR responsiveness. In contrast with AtPHYB(YH) experiments, AtPHYA(YH) expression poorly complements the phyA mutant (if at all), while its expression in wild type inhibits the normal FRc hypocotyl growth inhibition response (FIG. 3). These results indicate that AtphyA(YH) interferes with AtphyA(WT) signaling even though it cannot transduce the FRc signal. Among the possible explanations for these results include: 1) AtphyA (YH) is biologically inactive due to an altered protein conformation, 2) AtphyA(YH) is intrinsically unstable and is rapidly degraded/sequestered, 3) AtphyA(YH) heterodimerizes with AtphyA(WT) inhibiting its ability to transduce the light signal (eg. via enhanced degradation, dark reversion or competition for AtphyA(WT) homodimerization), 4) AtphyA (YH) interacts with downstream signaling partners to inhibit their productive interaction with AtphyA(WT), 5) AtphyA (YH) down-regulates transcription of its own mRNA (or mRNA stability), or 6) AtphyA(YH) consumes much of the bilin chromophore precursor to inhibit synthesis of AtphyA (WT) holoprotein.

Dark Grown AtPHYB(YH)-Expressing Seedlings, but not Those Expressing AtPHYA(YH), Exhibit Dominant Constitutive Photomorphogenesis.

Flowering plants grown in darkness etiolate—a skotomorphogenesis developmental program consisting of rapid hypocotyl/mesocotyl/epicotyl elongation growth, repression of hook opening, cotyledon/leaf expansion, as well as altered plastid development. Etiolation is designed to facilitate emergence from soil until sufficient light is available for photoautotrophic growth. Phytochrome is a major photosensor that regulates deetiolation of developing seedlings following skotomorphogenesis, its photoconversion triggering hypocotyl/mesocotyl/epicotyl growth inhibition, apical hook opening, cotyledon/leaf expansion and expression of the photosynthetic apparatus (Smith (1995) *Ann. Rev. Plant Physiol. Plant Mol. Biol.* 46: 289-315). PhyA, phyB and phyAphyB null mutants etiolate normally, demonstrating that phytochromes do not actively repress photomorphogenesis in darkness (Smith et al. (1997) *Plant Physiol.* 114: 637-641). Phytochrome overexpression also does not affect etiolation; dark grown seedlings overexpressing PHYA or PHYB are indistinguishable from wild type and null mutants (McCormac et al. (1993) *Plant J.* 4: 19-27). Comparative phenotypic analysis of transgenic plants expressing AtPHYB(WT) and AtPHYB(YH) shown in FIG. 4 reveals that AtPHYB(YH) expressing transgenic plants develop in complete darkness as if they were grown in light—a result that starkly contrasts with the etiolated phenotype of Ler wild type, phyB null mutants and transgenic lines expressing AtPHYB(WT). Since this constitutive photomorphogenetic (cop) phenotype is seen in the Ler wild type background in heterozygous as well as homozygous AtPHYB(YH) transgenic seedlings, the cop phenotype is dominant. A similar analysis was performed with AtPHYA(WT)- and AtPHYA(YH)-expressing transgenic plants (FIG. 5). These experiments indicate that the YH allele of AtPHYA does not possess the same gain-of-function activity as AtPHYB(YH).

More Detailed Photobiological Analysis of AtPHYB(YH) and AtPHYA(YH) Transgenic Lines in Sucrose-free Media.

The phenotypic analyses presented in FIGS. 2-5 were performed using seedings grown on solid media supplemented with 1% w/v sucrose. To avoid the effect of sucrose on seedling growth, quantitative hypocotyl growth measurements were performed on seedlings grown without sucrose. Immunoblot data was also obtained to determine the level of phytochrome protein levels in the various lines. These results, described in detail below and depicted in FIGS. 6-10, are qualitatively similar to those reported above. By transforming the AtPHYB(YH) and AtPHYA(YH) constructs into bilin-deficient hy1 backgrounds, these experiments also addressed the necessity of bilin chromophore for the observed phenotypes. The biological activity of other YX mutations of AtPHYB was also examined.

Bilin Chromophore is Required for the Constitutive Signaling Activity of AtPHYB(YH).

Figure 6:
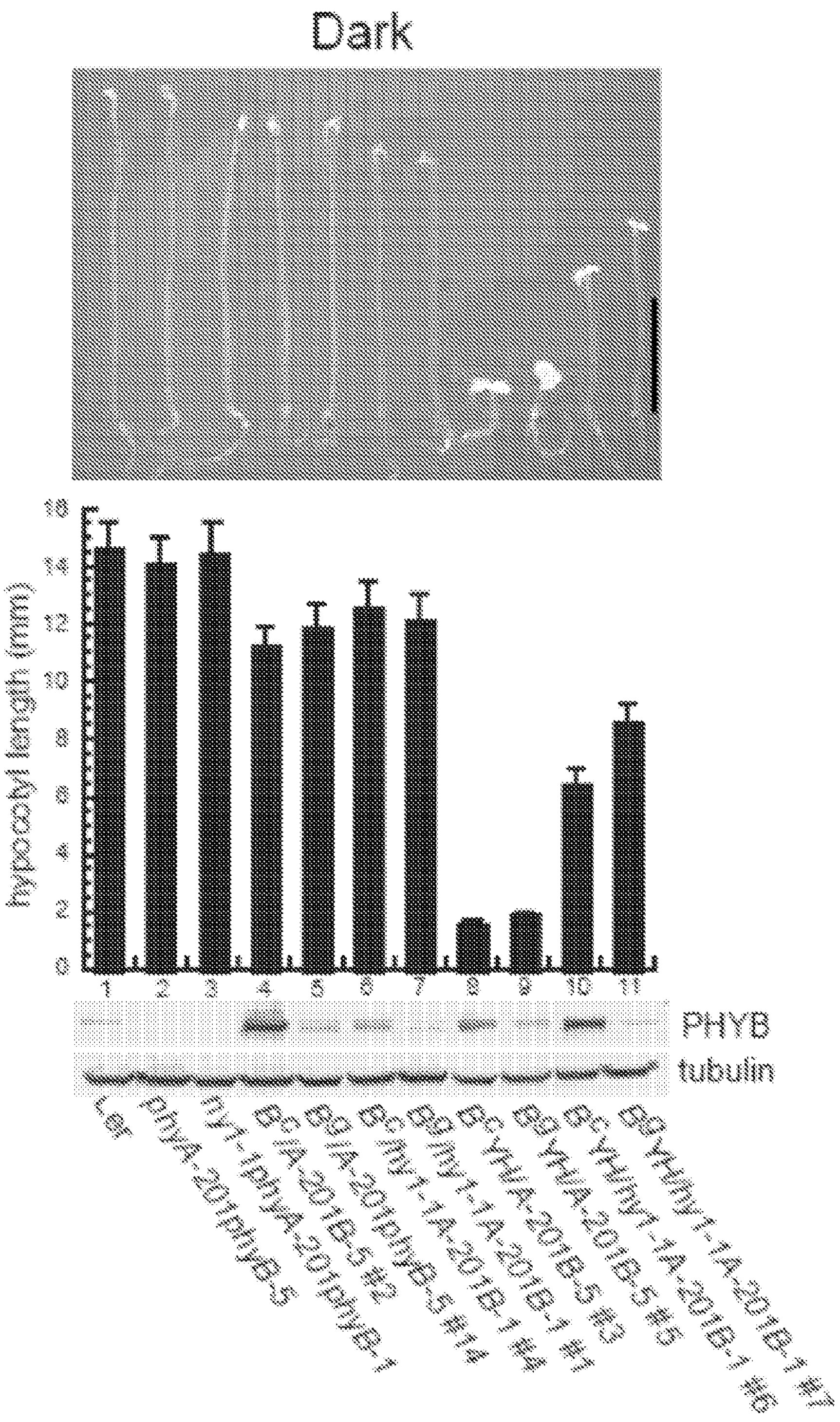
FIG. 6 shows the seedling phenotype of dark-grown parent lines and AtPHYB(WT)- and AtPHYB(YH)-expressing transgenic lines on sucrose-free agar media. Six day-old seedlings grown in darkness on 1× Mirashige-Skoog medium lacking sucrose are shown. Shown are seedling photographs (top), hypocotyl length (middle) and anti-PHYB and anti-tubulin immunoblots for dark-grown plant extracts (bottom). The scale bar indicates 5 mm length and promoters are those indicated in FIG. 1.

Comparisons of the dark-grown phenotype of AtPHYB (WT) and AtPHYB(YH) transgenics in wild type Ler and isogenic phyA-201phyB-5 double and hy1-1phyA-201phyB-1 triple null mutant backgrounds are shown in FIG. 6. These results show that the presence/absence of both phytochromes and/or chromophore had no effect on etiolated growth; hypocotyl lengths of all three parent lines were identical (lanes 1-3). Expression of either 35S promoter-driven cDNA or genomic fragment for AtPHYB(WT) driven by its own promoter led to a slight 15-24% inhibition of hypocotyl elongation (lanes 4-7). By contrast, expression of AtPHYB (YH) lead to >90% growth inhibition in the double mutant background (lanes 8 & 9). Growth inhibition observed in darkness was accompanied by hook opening and cotyledon expansion, hallmarks of photomorphogenetic development, that were not observed in AtPHYB(WT)-expressing transgenics Hypocotyl growth inhibition of AtPHYB(YH)-expressing transgenics was considerably suppressed in the hy1 background indicating that bilin chromophore is required for full cop gain-of-function activity of the YH mutant. Since the hy1 mutant is leaky owing to the presence of other HY1-related genes in *Arabidopsis* (Muramoto et al. (2002) *Plant Physiol.* 130: 1958-1966; Davis et al. (2001) *Plant Physiol.* 126: 656-669; Emborg et al. (2006) *Plant Physiol.* 140: 856-868), the partial morphogenesis observed for AtPHYB(YH) transgenics (i.e. 40-55% growth inhibition) likely reflects partial chromophorylation of the AtPHYB(YH) apoprotein. This interpretation is consistent with the residual phyB-mediated growth inhibition observed in hy1phyA double mutants under Rc (approx 50% of dark control), not seen in Rc-grown hy1phyAphyB triple mutants (Table 3). Western blot analysis shown in the bottom panel of FIG. 6 shows that the gain-of-function cop phenotype was not due to elevated accumulation of the AtPHYB(YH) protein.

TABLE 3

Percentage of hypocotyl growth inhibition in red light compared to six-day-old dark grown seedlings.

| | % of hypocotyl growth inhibition in red light compared to dark grown seedlings[a] |
|---|---|
| Ler | 62.51 +/− 5.09% |
| hy1-1 | 14.47 +/− 10.35% |
| hy1-1phyB-1 | 19.98 +/− 11.5% |
| hy1-1phyA-201 | 45.07 +/− 8.41% |
| hy1-1phyA-201phyB-1 | −8.34 +/− 16.2% |

[a](mean +/− sd); fifty seedlings measured

The Constitutive Signaling Activity of AtphyB(YH) is Light-Independent.

Figure 7:
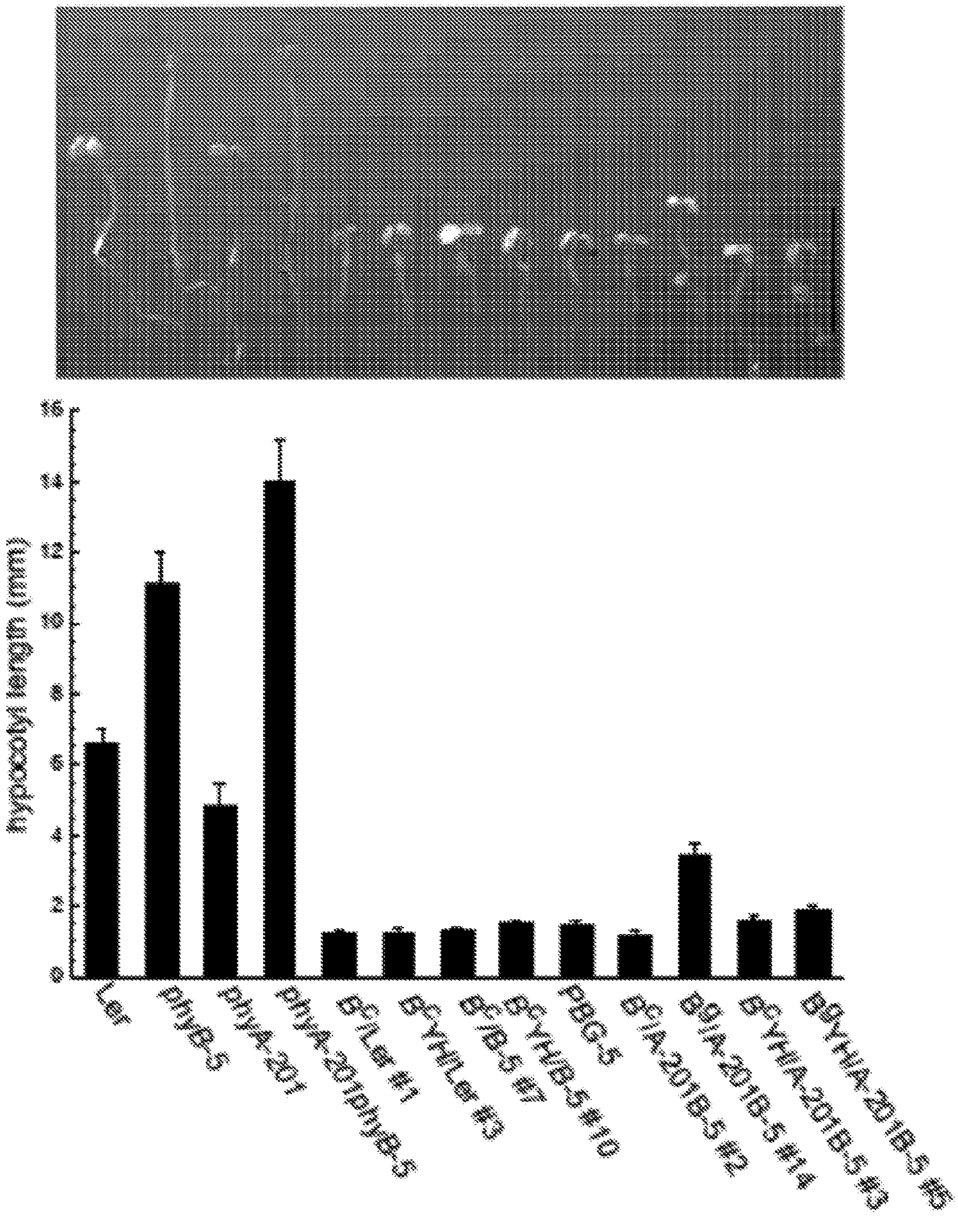
FIG. 7 shows the seedling phenotype of Rc- and dark-grown parent lines and AtPHYB(WT)-, AtPHYB-GFP- and AtPHYB(YH)-expressing transgenic lines on sucrose-free agar media. Six day-old seedlings grown in darkness or 20 μmol $m^{-2}$ $sec^{-1}$ continuous red light (Rc) on 1× Mirashige-Skoog medium lacking sucrose are shown. Shown are seedling photographs (top), hypocotyl length (middle) and anti-PHYB and anti-tubulin immunoblots for dark-grown plant extracts (bottom right). The scale bar indicates 5 mm length and promoters are those indicated in FIG. 1.

Comparisons of the Rc- and dark-grown phenotypes of AtPHYB(WT), AtPHYB-GFP(WT) and AtPHYB(YH) transgenics in wild type Ler and isogenic phyB-5 and phyA-201phyB-5 double null mutant backgrounds are shown in FIG. 7. These measurements show that, regardless of construct and/or promoter used to drive expression, that all WT and YH AtPHYB constructs complement the phyB and phyA-phyB long hypocotyl phenotype under 20 $\mu mol^{-1}\ m^{-2}\ s^{-1}$ Rc (top panel; lanes 6-13), while only AtPHYB(YH) effects a dark-grown cop phenotype (middle panel; lanes 6, 8, 12 and 13). Western blot analysis (bottom panel) indicates that the observed phenotypes do not reflect over accumulation of the AtPHYB protein. Taken together, these results show that the constitutive signaling activity of AtphyB(YH) is light-independent.

AtPHYA(YH) Expression in Ler Wild-type Confers a Dominant Negative Phenotype and Partial Constitutive Signaling Activity in phyA Null Backgrounds.

Figure 8:
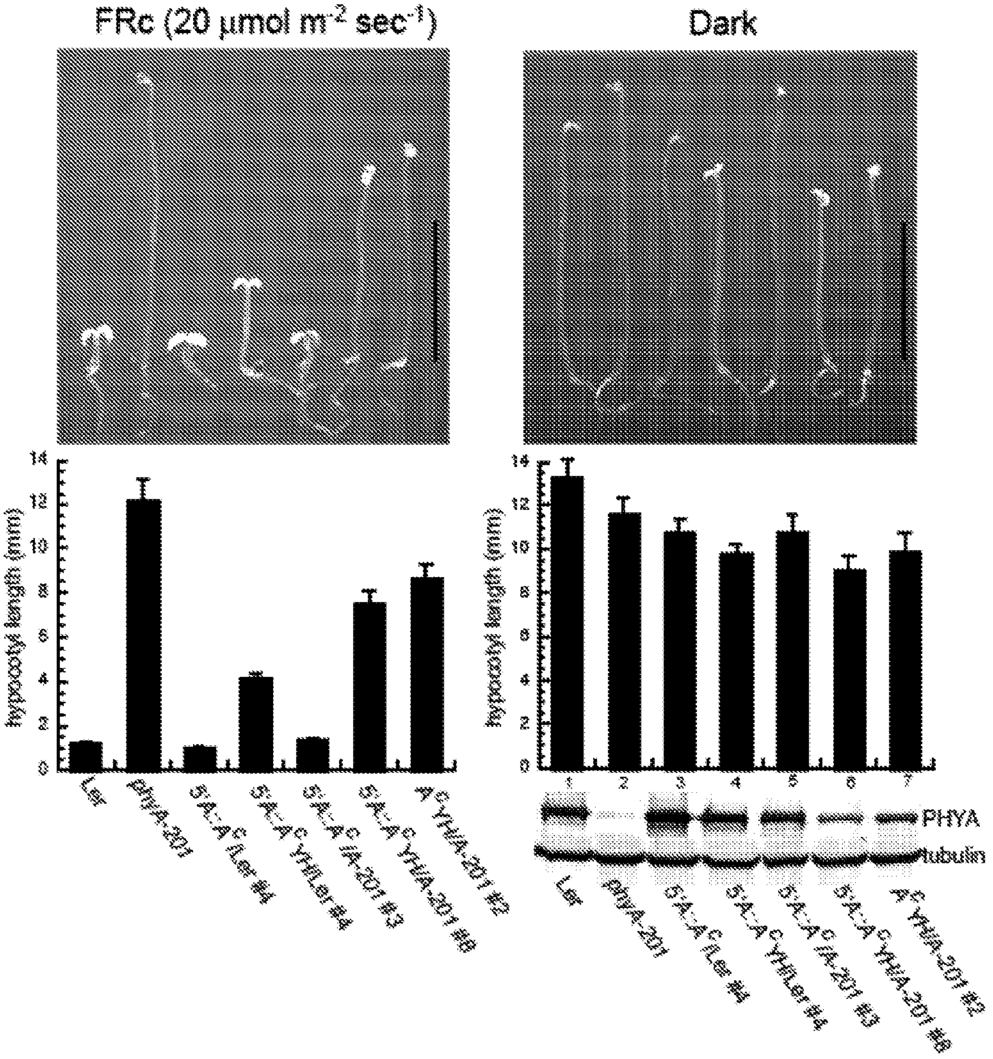
FIG. 8 shows the seedling phenotype of FRc- and dark-grown parent lines and AtPHYA(WT)- and AtPHYA(YH)-expressing transgenic lines on sucrose-free agar media. Six day-old seedlings grown in darkness or 20 μmol $m^{-2}$ $sec^{-1}$ continuous far red light (FRc) on 1× Mirashige-Skoog medium lacking sucrose are shown. Shown are seedling photographs (top), hypocotyl length (middle) and anti-PHYA and anti-tubulin immunoblots for dark-grown plant extracts (bottom right). The scale bar indicates 5 mm length and promoters are those indicated in FIG. 1.

Comparisons of the FRc- and dark-grown phenotypes of AtPHYA(WT) and AtPHYA(YH) transgenics in wild type Ler and the isogenic phyA-201 null mutant background are shown in FIG. 8. These measurements indicate that while WT AtPHYA fully complements the phyA mutant under 20 $\mu mol^{-1}\ m^{-2}\ s^{-1}$ FRc (compare lanes 1, 2 and 5), AtPHYA(YH) incompletely complements the phyA mutant under FRc (compare lanes 1, 2, 6 and 7). Moreover, AtPHYA(YH) production in wild type Ler background inhibits the function of the wild type AtphyA under FRc since hypocotyl lengths of AtPHYA(YH)-expressing plants in the wild type Ler background are longer than those of the Ler parent (left panel; compare lane 4 with lane 1). Similar to the results described in sucrose-containing media (FIG. 5), expression of either AtPHYA(WT) or AtPHYA(YH) has little dramatic effect on the phenotype of dark grown seedlings. Compared with Ler wild type however, expression of both transgenes leads to a slight inhibition of hypocotyl growth and partial cotyledon expansion and hook opening of all YH transgenics are detected. Western blot analysis (bottom right panel) indicates that over accumulation of the expressed AtPHYA protein do not account for the observed phenotypes, nor does severe reduction in the wild type protein in Ler wild type background appear responsible for the dominant negative phenotype. These data indicate that the AtPHYA(YH) protein, not only interferes with wild type phyA signaling under FRc, but also exhibits partial constitutive signaling activity.

AtPHYB Mutant Expression Reveals that Fluorescent YX Alleles Exhibit Constitutive Signaling Activity, while Non-fluorescent Alleles do not.

Figure 4:
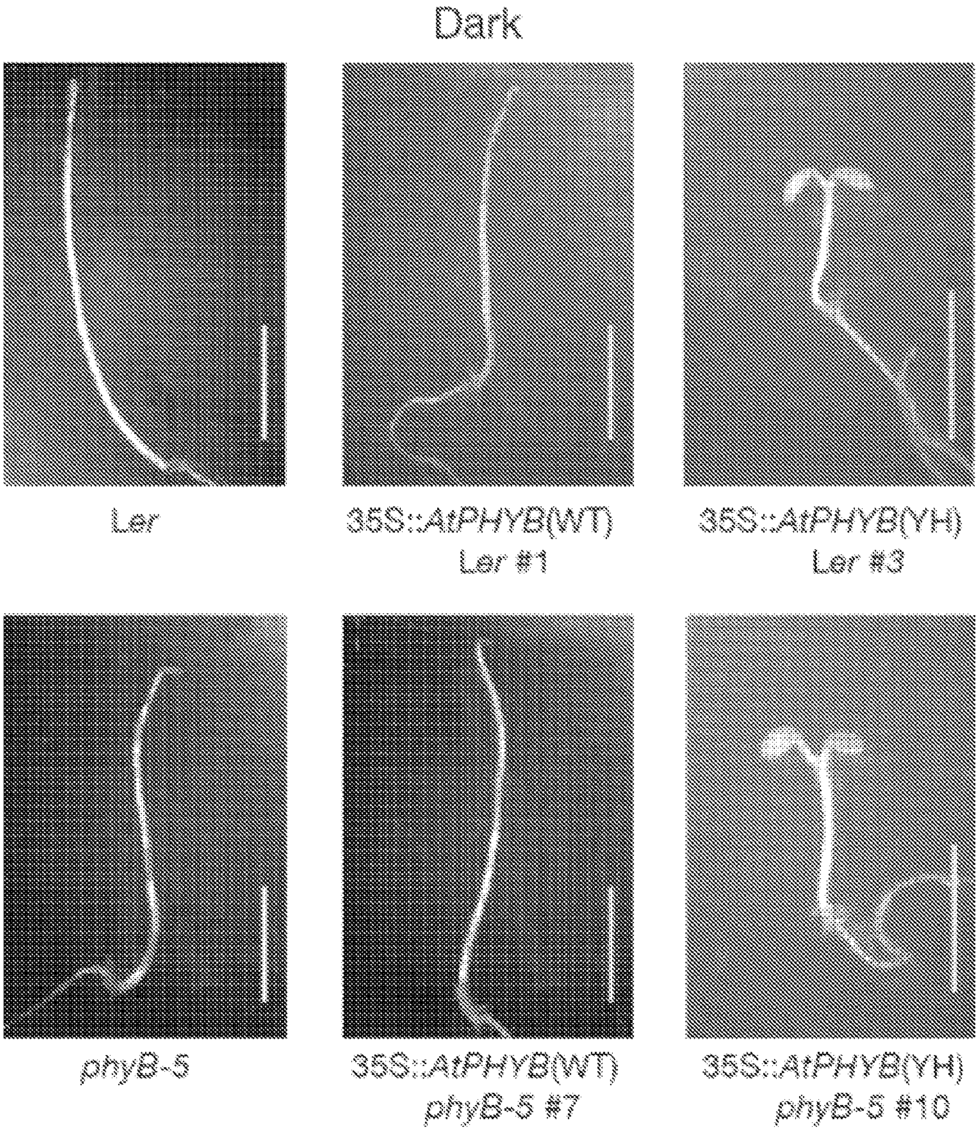
FIG. 4 (6 panels) shows the seedling phenotype of dark-grown parent lines and AtPHYB(WT)- and AtPHYB(YH)-expressing transgenic lines on sucrose-containing agar media. Six day-old seedlings grown in continuous darkness on 0.5× Mirashige-Skoog medium supplied with 1% sucrose are shown. Top panels show wild type Ler and representative AtPHYB(WT) and AtPHYB(YH) transgenic lines in the Ler background. Bottom panels show phyB-5 mutant and representative AtPHYB(WT) and AtPHYB(YH) transgenic lines in the phyB-5 mutant background. The scale bar indicates 5 mm length and promoters are those indicated in FIG. 1.
Figure 5:
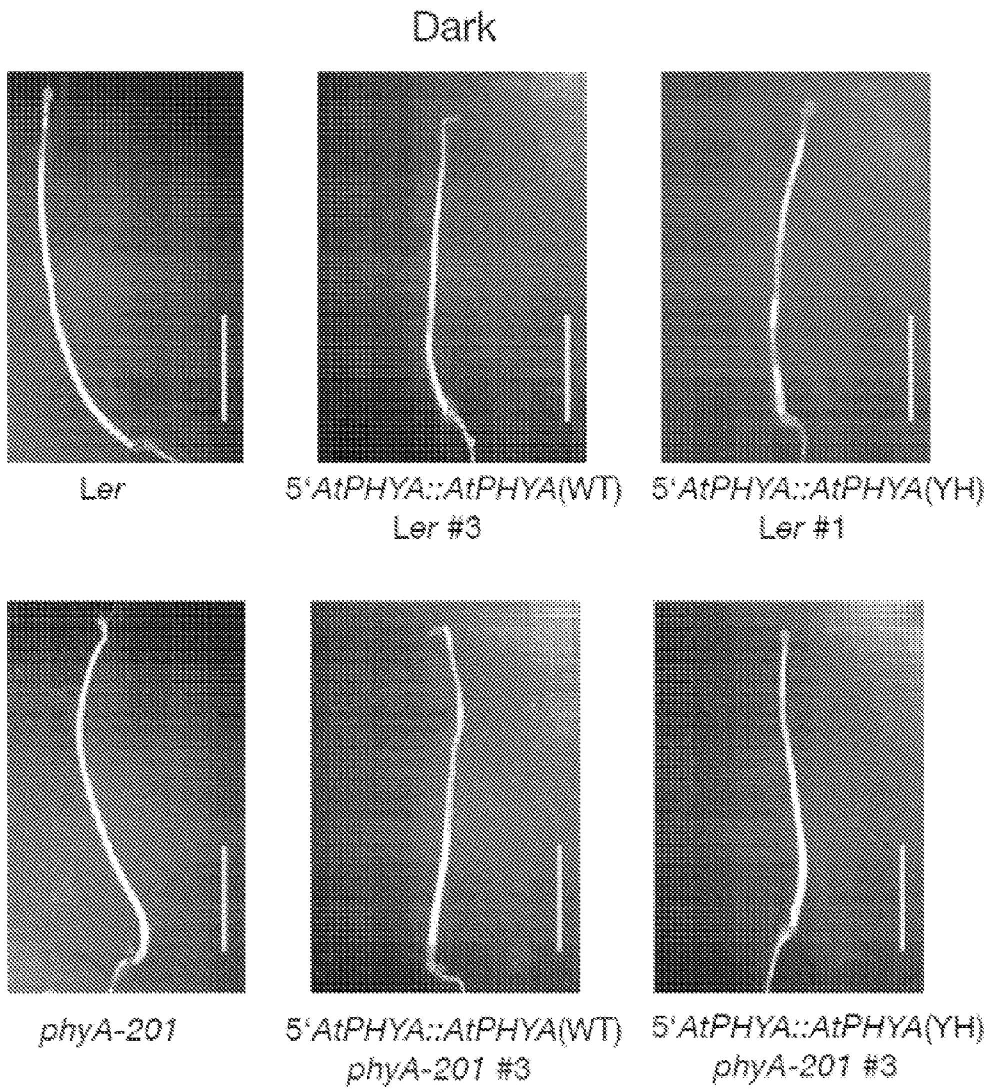
FIG. 5 (6 panels) shows the seedling phenotype of dark-grown parent lines and AtPHYA(WT)- and AtPHYA(YH)-expressing transgenic lines on sucrose-containing agar media. Six day-old seedlings grown in complete darkness on 0.5× Mirashige-Skoog medium supplied with 1% sucrose are shown. Top panels show wild type Ler and representative AtPHYB(WT) and AtPHYB(YH) transgenic lines in the Ler background. Bottom panels show phyA-201 mutant and representative AtPHYB(WT) and AtPHYB(YH) transgenic lines in the phyA-201 mutant background. The scale bar indicates 5 mm length and promoters are those indicated in FIG. 1.
Figure 9A:
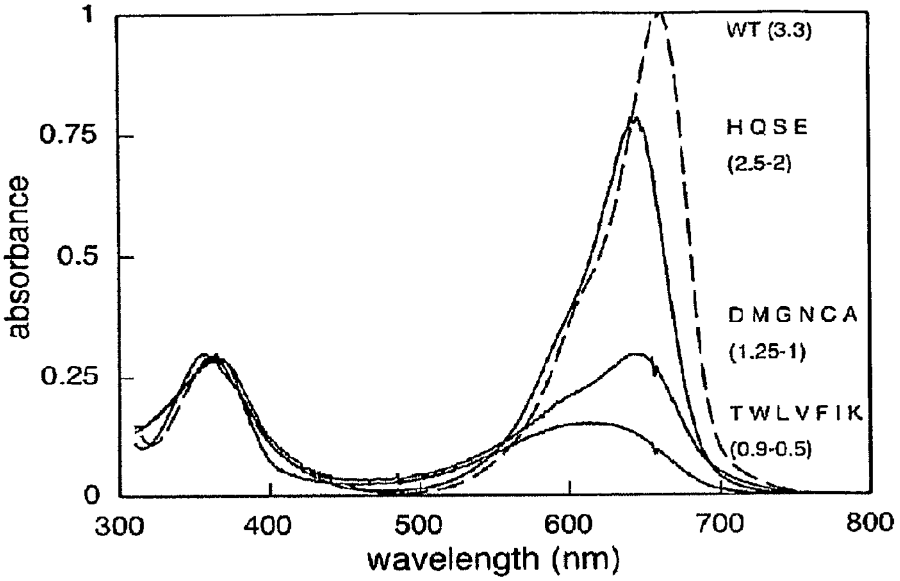
FIGS. 9A and 9B show spectroscopic properties of recombinant Cph1(N514) WT and YX mutants. Adapted from FIG. 3 (panel A) and FIG. 4 (panel B) from Fischer et al. (2005) *Biochem. ACS* 44: 15203-15215.
Figure 9B:
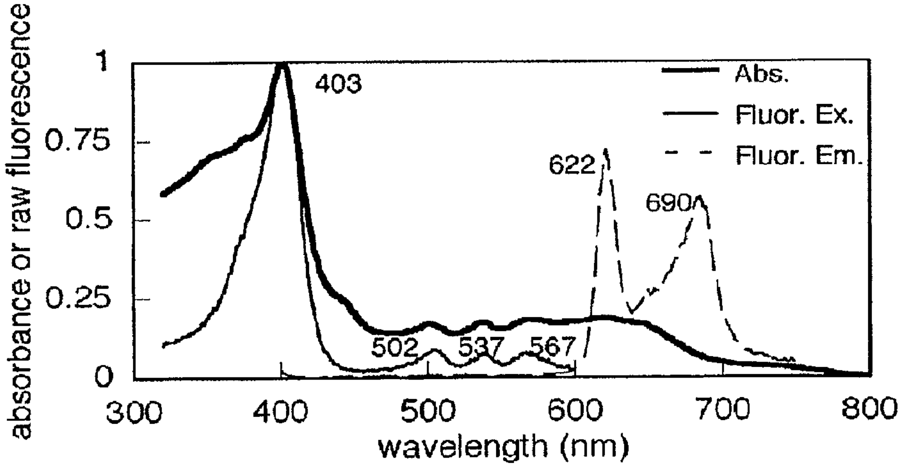
Figure 10:
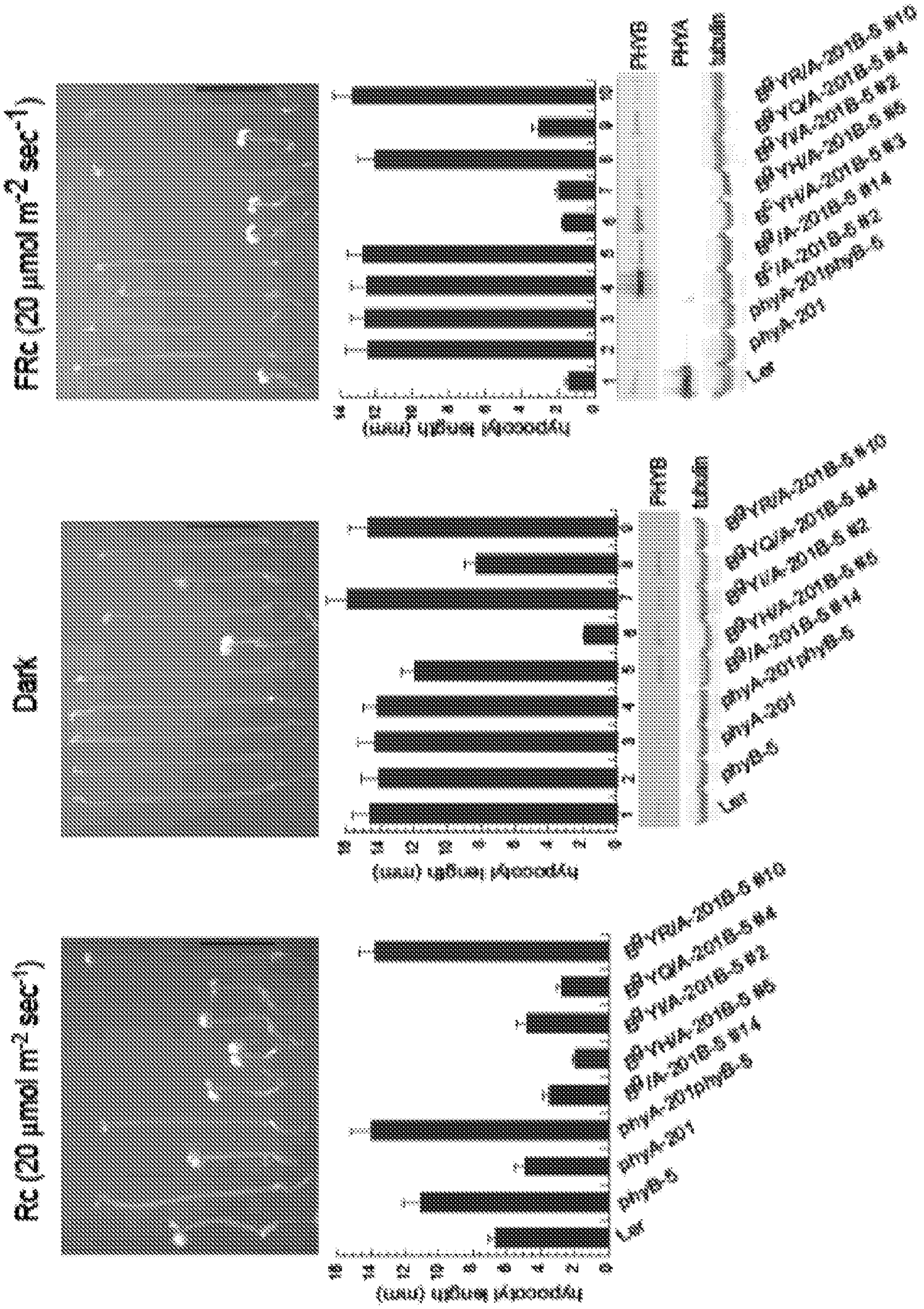
FIG. 10 shows seedling phenotype of Rc-, FRc- and dark-grown parent lines and AtPHYB(WT)- and AtPHYB(YX)-expressing transgenic lines on sucrose-free agar media. Six day-old seedlings grown in darkness or 20 μmol $m^{-2}$ $sec^{-1}$ continuous red (Rc) or far red light (FRc) on 1× Mirashige-Skoog medium lacking sucrose are shown. Shown are seedling photographs (top), hypocotyl length (middle) and anti-PHYA, anti-PHYB and anti-tubulin immunoblots for dark-grown plant extracts (middle & bottom right). The scale bar indicates 5 mm length and promoters are those indicated in FIG. 1.

Four spectroscopically distinct classes of YX alleles were identified by the saturation mutagenesis of Cph1-fluorescent alleles with extended bilin chromophores (i.e. YH and YQ), non-fluorescent alleles with less extended, porphyrin-like bilin chromophores (i.e. YI) and one allele that binds to an endogenous porphyrin (i.e. YR) shown in FIG. 9 (adapted from FIGS. 4 and 6A; (Fischer et al. (2005) Biochem. 44: 15203-15215)). One mutation from each class was chosen to construct transgenic plants with a second fluorescent mutant allele, i.e. YQ, used for comparison with YH. Comparisons of the Rc-, FRc- and dark-grown phenotypes of transgenic plants expressing WT or YH, YI, YQ and YR mutants of AtPHYB in the phyA-201phyB-5 null mutant background are shown in FIG. 10. Under 20 $\mu mol^{-1}\ m^{-2}\ s^{-1}$ Rc, WT and all YX mutants of AtPHYB except YR effectively complement the phyB-deficient phenotype of the phyA-201phyB-5 double mutant Hypocotyl lengths of WT, YH, YI and YQ transgenics were even shorter than those of Ler wild type and phyA-201 seedlings, both of which possess a functional phyB photoreceptor. This enhanced activity probably reflects the increased level of expression of the AtPHYB transgene compared with the wild type alleles in Ler and phyA-201 (see immunoblot; middle panel bottom). As shown by immunoblot, the lack of Rc responsiveness of the YR mutant was not due to the absence of YR protein. We did not determine whether YR received a chromophore however, which may account for its lack of photoresponsiveness. By comparison, dark-grown seedlings expressing only the fluorescent YH and YQ alleles of AtPHYB displayed a constitutive photomorphogenetic phenotype (FIG. 10; middle panel, lanes 6 & 8). This result indicates that YI and YR alleles are not constitutively active in the dark (lanes 7 & 9), nor is WT (lane 5). If YH and YQ alleles were constitutively active, we would also expect to see a phenotype under FRc. As shown in the right panel of FIG. 10, both YH and YQ are active under FRc (lanes 6, 7 & 9) while WT AtPHYB overexpression (lane 4) fails to complement the phyA deficiency. These data show that the fluorescent YH and YQ alleles of AtPHYB are constitutively active, with the activity of YQ being quantitatively less than the YH allele. Whether this difference reflects the level of chromophorylation or intrinsic biological activity was not determined.

Dark-grown AtPHYB(YH) Expressing Seedlings Exhibit Enhanced Gene Expression of Light-regulated Genes that Reflect the Constitutive Nuclear Localization of the Mutant Photoreceptor.

Figure 11:
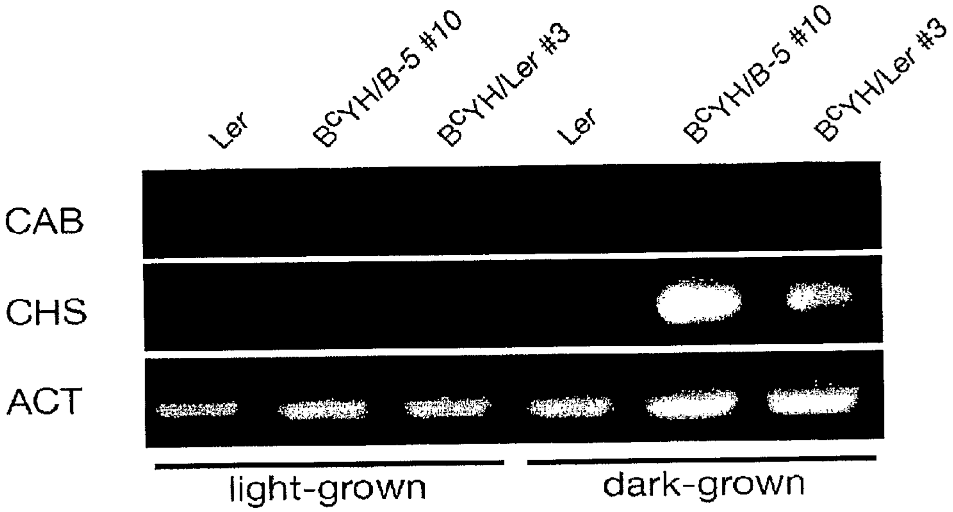
FIG. 11 shows an RT PCR analysis of CAB and CHS expression in light- and dark-grown wild type Ler and AtPHYB(YH)-expressing transgenic lines. RT-PCR was performed using the RNA isolated from seven-day-old light or dark grown seedlings. CAB and CHS were expressed in light grown wild type Ler, both in light and dark AtPHYB(YH)-expressing transgenic lines but not in dark grown wild type Ler. This result indicates that expression of AtPHYB(YH) is able to activate the expression of light-responsive genes without light treatment and is dominant.
Figure 12A:
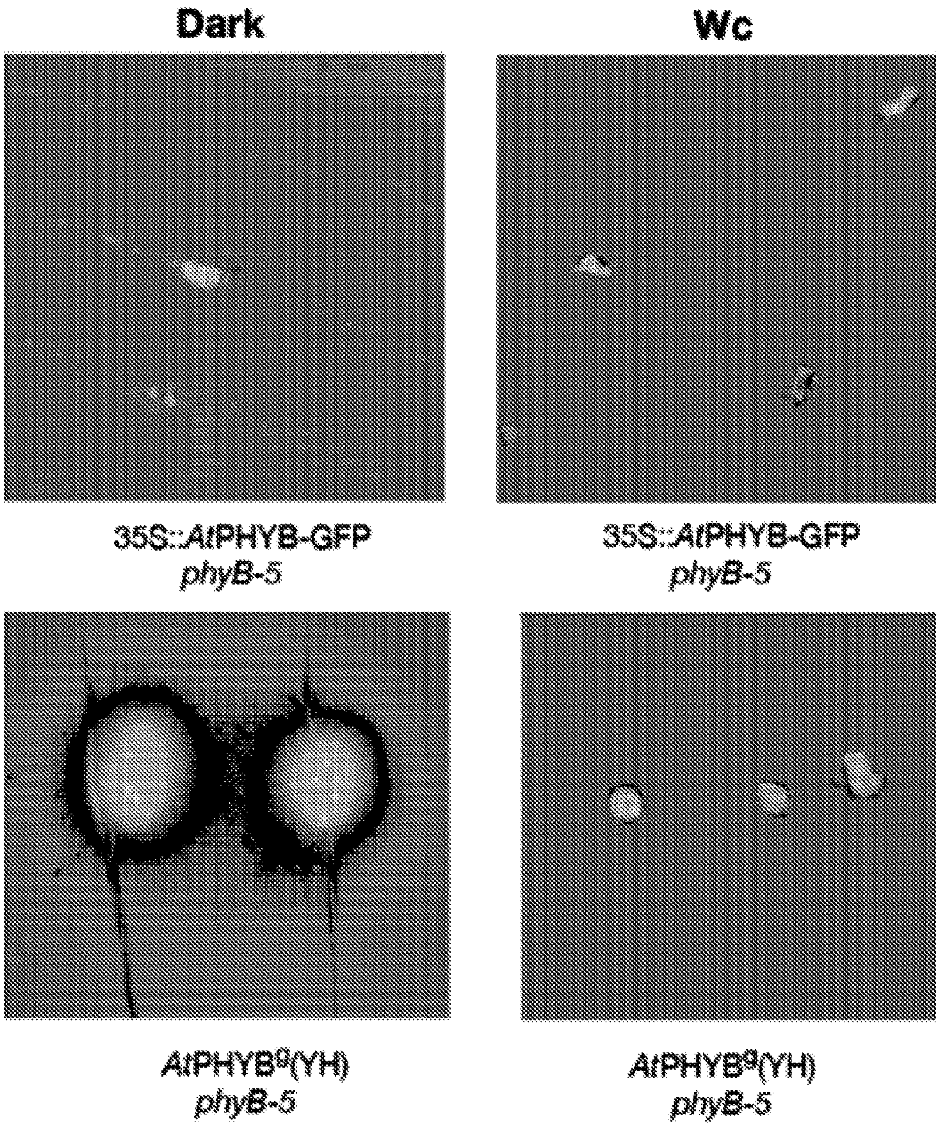
FIGS. 12A and 12B show the comparative subcellular localization of the AtphyB(YH) and AtphyB(WT)-GFP holoproteins in dark and light-grown plants by fluorescence microscopy. Five day-old seedlings grown in darkness or under continuous white light (80 μmol $m^{-2}$ $sec^{-1}$) on 0.5× Mirashige-Skoog medium with 1% w/v sucrose were stained with DAPI and placed on a microscope slide immersed in PBS buffer. Overlaid images showing nuclei, AtphyB(WT)-GFP and AtphyB(YH) holoprotein are shown. Images shown were obtained with a API DeltaVision Deconvolution Microscope (FIG. 12A) or an Olympus FV1000 Laser Scanning Confocal Microscope (FIG. 12B) and were processed as described in Materials and Methods.
Figure 12B:
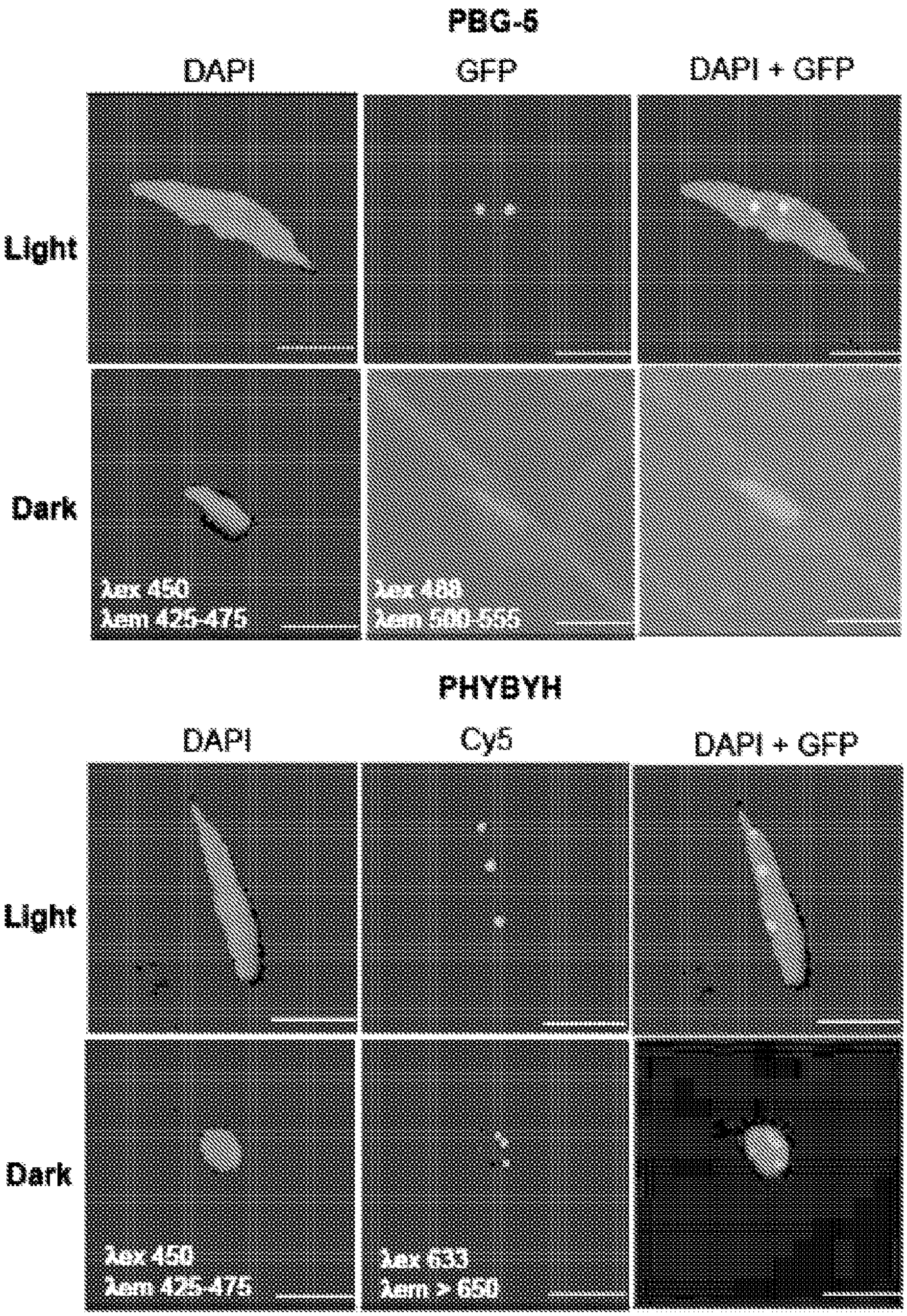

The hallmark of photomorphogenesis at the molecular level is the expression of numerous genes that are normally repressed in darkness (Schäfer and Nagy eds. (2005) *Photomorphogenesis in Plants and Bacteria: Function and Signal Transduction Mechanisms* (3rd Edition), 3rd Edition (Dordrecht, The Netherlands: Springer)). Since dark-grown AtPHYB(YH)-expressing seedlings develop as if they were light-grown, we compared the expression of two strongly light-regulated genes, chlorophyll a/b binding protein (CAB) and chalcone synthase (CHS), using RT PCR of RNA isolated from dark- and light-grown Ler and transgenic lines expressing AtPHYB(YH) in Ler or phyB-5 mutant backgrounds. These experiments shown in FIG. 11 reveal that both genes are expressed equal to or greater than wild-type levels in both dark-grown YH transgenics. Microarray experiments are in progress to assess whether all, or a subset of light-regulated genes are expressed/repressed in dark-grown YH transgenics. The regulation of gene expression by phytochrome has been well established to involve the light driven migration of the cytosolically localized photoreceptor upon Pr to Pfr phototransformation (Nagatani (2004) *Curr. Opinion in Plant Biology* 7: 708-711). Indeed, GFP chimeras with both PHYA and PHYB have been used to document this phenomenon (Nagy et al. (2001) *J. Cell Sci,* 114: 475-480). Since the YH allele is intrinsically red fluorescent, we compared the localization of a AtPHYB(WT)-GFP chimera with AtPHYB(YH) in both light- and dark-grown seedlings using fluorescence microscopy (FIG. 12). These analyses show that the YH mutant is localized to nuclear speckles in both dark and light-grown AtPHYB(YH) transgenics while the AtPHYB(WT)-GFP remains mostly cytosolic in dark-grown seedlings, requiring light treatment for nuclear migration and speckle formation. Based on these results, we conclude that the YH mutation confers constitutive photomorphogenesis by locking the mutant holoprotein into an active "Pfr-like" signaling state that facilitate nuclear migration and interaction with nuclear factors responsible for expression of light-regulated genes.

Spectroscopic Analysis of Recombinant YX Mutants.

Figure 13:
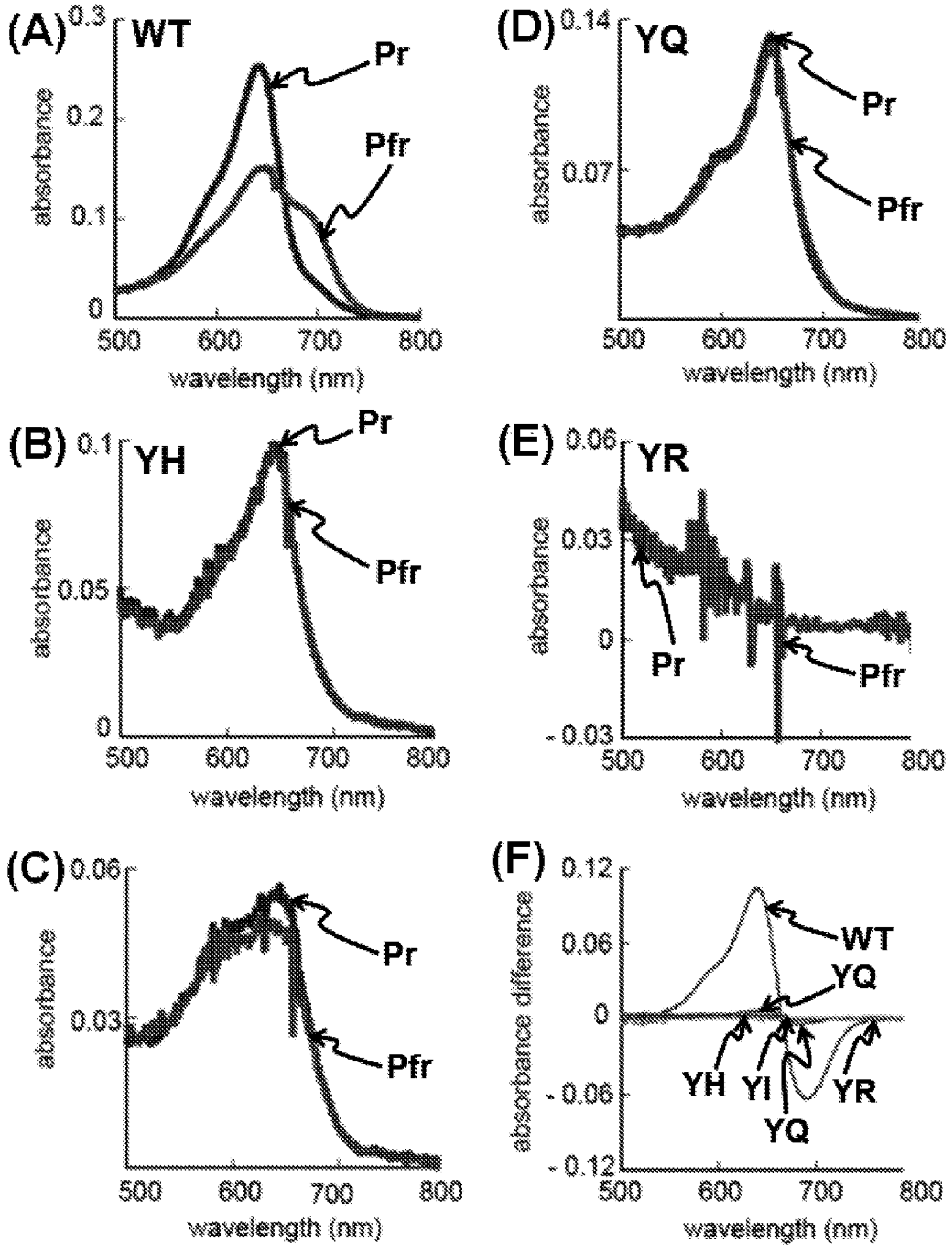
FIG. 13, panels A-F show spectroscopic properties of recombinant AtphyB(N450) WT and YX mutants. Recombinant expression of WT and YX mutant alleles of AtPHYB (N450) was performed in *E. coli* cell lines engineered to produce the PCB chromophore precursor as described in Materials and Methods. The absorption spectra and phytochrome difference spectra from 500-800 nm of the partially WT and YH, YI, YQ and YR mutant holoproteins are depicted here. (A)-(E): Pr and Pfr absorbance spectra. (F): WT, YH, YI, YQ, and YR difference spectra.

To assess the ability of the AtPHYB(YX) apoproteins to bind bilin, we introduced the YH, YI, YQ and YR mutants into a truncated AtPHYB(N450) plasmid that enabled expression and purification of holoprotein from *E. coli* (Fischer et al. (2005) *Biochem.* 44: 15203-15215). As shown in FIG. 13, co-expression of WT and three of the YX mutants yielded semi-purified holoproteins that possessed a visible light absorbing chromophore. The one exception was the YR AtPHYB(N450) mutant that lacked visible light-absorbing chromophore (although the level of the YR protein recovered may be too low to assess attachment). These measurements also showed that all of the YX mutants were poorly photoconvertible, with the YH and YQ exhibiting absorption spectra consistent with the presence of an extended bilin chromophore, while YI possessed a porphyrin-like, non-photoactive prosthetic group. Fluorescence measurements were also performed on these proteins, and like Cph1 studies, the YH and YQ mutants but not the YI and YR mutants of AtphyB(N450) exhibited enhanced red fluorescence (FIG. 13). These spectra are in good agreement with measurements of the corresponding YX mutants of Cph1 (Id.). Unlike Cph1 however, the YR mutant d id not appear to bind a porphyrin. Taken together, these data suggest that all except the YR mutant of AtPHYB are expected to assemble with a bilin chromophore in planta, however the level of chromophorylation of the AtPHYB proteins in our transgenic lines was not directly assessed.

Comparative Limited Proteolytic Analysis of Recombinant Cph1(WT) and Cph1(YH) Mutant Reveals that the YH Mutant is More Susceptible to Proteolysis.

Figure 14:
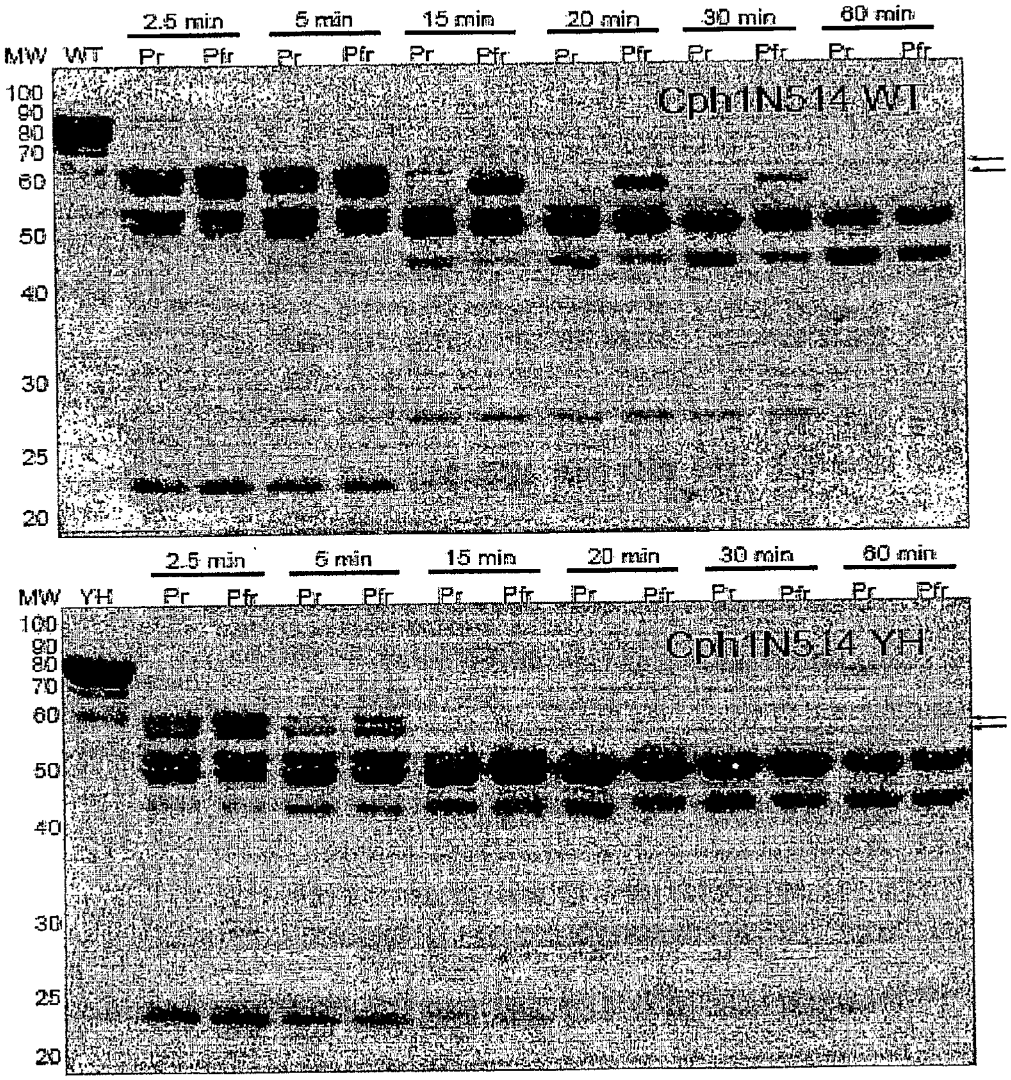
FIG. 14 shows the comparative limited proteolysis of WT and YH mutant of Cph1. Recombinant Cph1 wild type and YH mutant holoprotein were treated with trypsin and proteolytic fragments were separated on 12% SDS-PAGE and visualized by Coomassie blue staining. Arrows indicate the fragments relatively resistant to trypsin in Pfr forms of wild type Cph1. MW: molecular weight markers.

Comparative limited proteolysis has been used to probe light-induced conformational changes in both plant and cyanobacterial phytochromes (Lagarias and Mercurio (1985) *J. Biol. Chem.* 260: 2415-2423; Esteban et al. (2005) *Biochem.* 44: 450-461). Owing to the difficult to express, assemble and purify full length recombinant AtphyB, experiments were initially performed with recombinant Cph1. To assess whether the YH holoprotein adopted a Pr or Pfr-like conformation, we first compared the proteolytic susceptibility of full length Cph1(WT) following saturating red and far red irradiation with similarly treated Cph1(YH). The time courses of proteolysis with trypsin are shown on the Coomassie. Blue stained SDS polyacrylamide gels in FIG. 14. These studies confirm earlier results that Pr and Pfr forms of Cph1 have distinct protein conformations (left panel). As expected for the fluorescent, non-photoactive YH mutant, light treatment had no effect on the kinetics or pattern of its proteolytic degradation. Moreover, the YH mutant appeared to degrade more rapidly than WT Cph1 with a pattern more similar to the Pfr form. At early timepoints following trypsin addition, the proteolytic fragmentation pattern for YH resembled that of the Pfr form of YH with fragment being slightly more stabilized than that seen in the Pr form (FIG. 14). While subtle, these data support the interpretation that YH adopts a light-independent "Pfr-like" conformation. Preliminary experiments were also performed with full length recombinant oat phyA expressed in yeast, and by analyzing the light-dependency of proteolytic cleavage of WT and YH mutants of oat PHYA expressed in phyA-null backgrounds (data not shown). These experiments suggest that the YH mutants are more proteolytically labile than the WT photoreceptors, however the potential artifacts inherent for such experiments using impure phytochromes do not permit resolution of the protein conformations. Resolution of this hypothesis for AtPHYB must await better systems for expression and purification of the recombinant holoproteins. This will also facilitate experiments to compare the protein kinase activities of the WT and YH mutant photoreceptors.

Adult Phenotype of transgenic AtPHYB Plants.

Figure 15A:
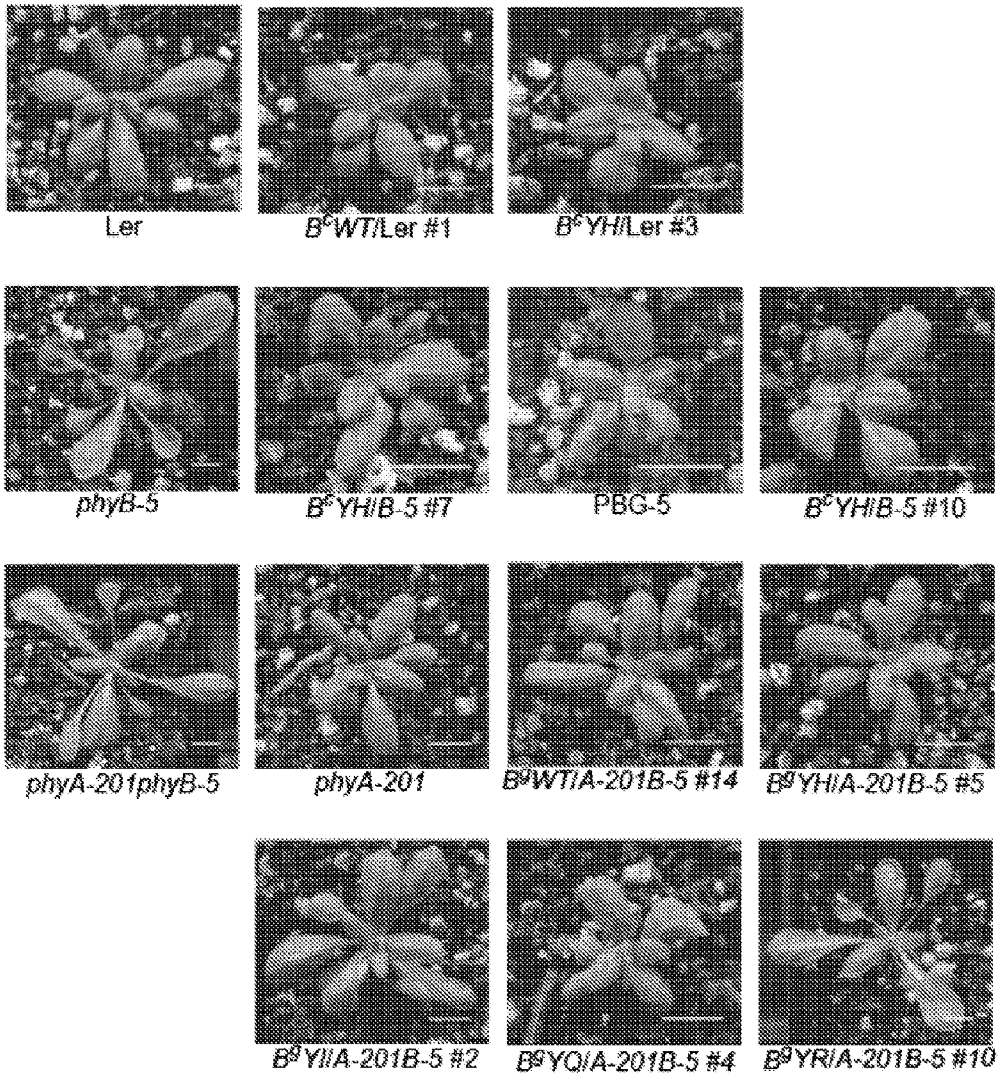
FIGS. 15A, 15B, and 15C show the comparative adult phenotype of light-grown Ler WT and AtPHYA(WT)-, AtPHYB(YH)-, AtPHYB(YI)-, AtPHYB(YQ)- and AtPHYB (YR)-expressing transgenic plants.
Figure 15B:
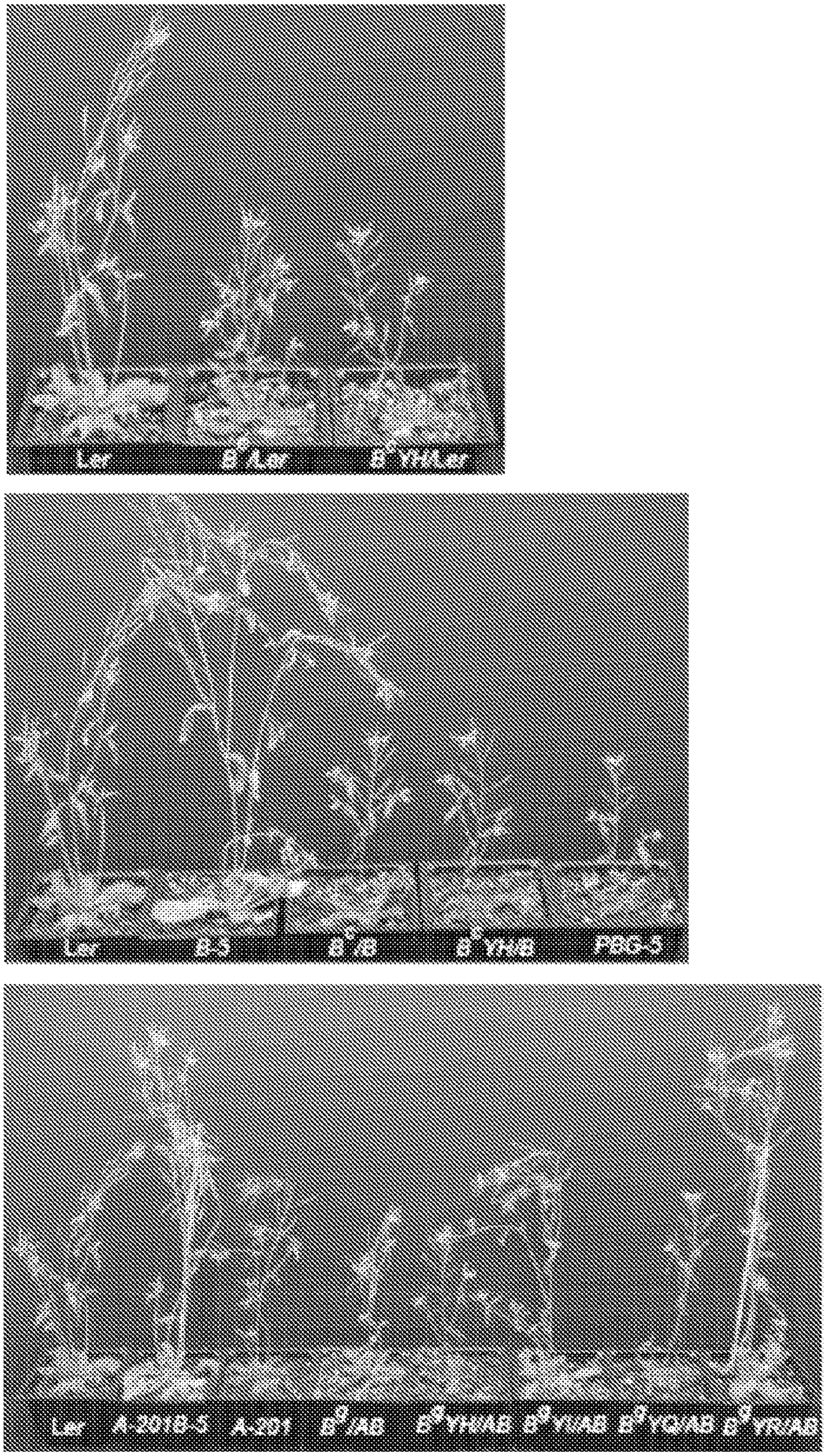
Figure 15C:
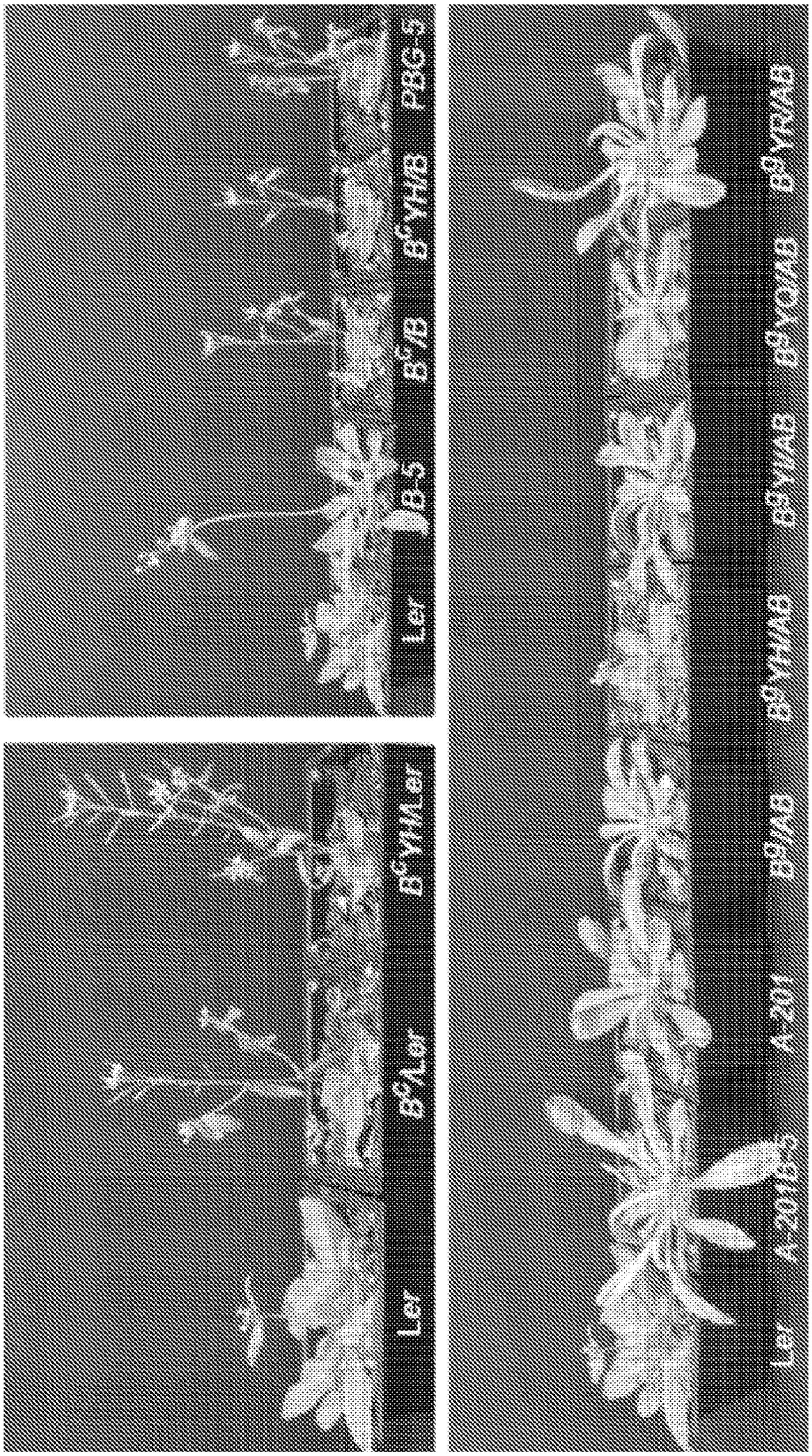

PhyB-deficient plants exhibit constitutive shade avoidance responses, possessing elongated hypocotyls and petioles as well as exhibiting early flowering compared to wild type plants grown under the same light conditions (FIG. 15). Expression of the wild type PHYB gene in phyB-5 mutant rescues the constitutive shade avoidance response while the expression of the wild type PHYB gene in Ler wild type background effects hyper-responsiveness to light—with shorter hypocotyls and petioles. Transgenic plants expressing AtPHYB(YH) in both wild type Ler and phyB-5 mutant backgrounds have a smaller rosette diameter compared with plants expressing the wild type PHYB (FIG. 15), suggesting that the YH allele is more active in than the wild type one (although expression level differences may be responsible). YH, YI and YQ alleles could also rescue the shade avoidance response of phyB-5 under continuous light but to varying extent. YQ has similar activity as YH, while YI is more like wild type allele. By contract, expressing YR cannot rescue the shade avoidance response of phyB-5, which is consistent with the hypocotyl phenotype under red light. Both adult phenotype and hypocotyl length data indicate YR is not an active PHYB allele.

Example 2

Functional Analysis of Dominant GAF-domain Tyrosine Mutants of *Arabidopsis* Phytochromes in Transgenic Plants Light sensing by phytochromes, a family of biliprotein photoreceptors that are widely distributed nature, exploits the reversible photoisomerization of their covalently bound linear tetrapyrrole (bilin) prosthetic groups. Initially undertaken to examine the biological activity of a recently identified class of highly fluorescent, poorly photoactive phytochrome mutants in transgenic plants, the present investigation led to the unexpected discovery of constitutively active phytochrome alleles that possess mutations in a conserved GAF domain tyrosine ($Y^{GAF}$) residue. Most pronounced gain-of-function activities were observed for the Y276H allele of *Arabidopsis* phyB (YHB) whose expression conferred dominant constitutively photomorphogenic (COP) phenotypes as well as constitutive, light-insensitive phyB signaling activities to both dark- and light-grown transgenic plants. YHB-mediated COP development paralleled constitutive nuclear localization of the YITB protein and expression of light-regulated genes in darkness—both of which are consistent with its light-independent activation. Moreover, the COP phenotype was suppressed in bilin-deficient genetic backgrounds, indicating that the YHB allele encodes a bilin-dependent regulator of photomorphogenesis. Phenotypic analysis of transgenic plants expressing YQB, YIB and YRB alleles further revealed that the signaling activity of phyB critically depends on the amino acid at the $Y^{GAF}$ position. By comparison with YHB, the COP phenotype conferred by the Y242H allele of phyA (YHA) was less pronounced, and a dominant-negative response to YITA expression was observed in wild-type genetic backgrounds. Taken together, these results implicate participation of this conserved $Y^{GAF}$ residue in the transduction of light-driven bilin chromophore isomerization to phytochrome-mediated regulation of plant growth and development. Dominant, constitutively active phytochrome alleles are of potential agronomic significance since their introduction into any transformable crop plant species represents a practical approach to suppress deleterious responses to light quality in field environments.

Introduction

All life forms living at/or near the earth's surface possess a diverse array of photosensory receptors that trigger cellular signaling cascades to regulate adaptive biological responses to light at the organismal level (Chen et al. (2004) *Ann. Rev. Genet.* 38: 87-117; Franklin and Whitelam (2004) *J. Exp. Bot.* 55: 271-276; Schäfer and Nagy (2005) *Photomorphogenesis in Plants and Bacteria: Function and Signal Transduction Mechanisms* (3rd Edition). (Dordrecht, The Netherlands:

Springer)). Whether the particular response involves pigment biogenesis, movement, differential growth, or initiation of new genetic pathways that specify altered developmental outcomes such as sporogenesis, reproduction or programmed senescence, the adaptive significance is the same, i.e. to minimize photo-oxidative damage, to secure/conserve food sources, to avoid predation, and/or to propagate the species. Carotenoid-, flavin- and p-coumaric acid-based photoreceptors such as rhodopsins, cryptochromes, phototropins and xanthop sins were amongst the earliest of these to evolve, with the more oxidized bilin-based phytochrome photoreceptors appearing when the oxygen atmosphere on earth approached current levels over two billion years ago (van der Horst and Hellingwerf (2004) *Acc. Chem. Res.* 37: 13-20). It is not surprising that representatives of all of these photoreceptor families are distributed widely throughout all kingdoms of life on present day earth (Batschauer, A. (2003) *Photoreceptors and Light Signaling*. (Cambridge, UK: Royal Society of Chemistry); Briggs and Spudich (2005) *Handbook of Photosensory Receptors*. (Weinheim: Wiley VCH)).

The cohort of photoreceptors is most complex in photosynthetic organisms that must cope with the dual threat of too much or too little light (Falciatore and Bowler (2005) *Curr. Top. Dev. Biol.* 68: 317-350; Lariguet and Dunand (2005) *J. Mol. Evol.* 61: 559-569). Land plants therefore possess red/far-red (R/FR) light-absorbing phytochromes (Rockwell et al. (2006) *Ann. Rev. Plant Biol.* 57: 837-858), UV-A/blue (B) light-sensing cytochromes and phototropins (Briggs and Christie (2002) *Tr. Plant Sci.* 7: 204-210; Lin and Todo (2005) *Genome Biol.* 6: 220) and UV-B photoreceptors (Ballaré (2003) *Plant Physiol.* 132: 1725-1727) for perception of the full range of the solar light spectrum (Franklin et al. (2005) *Int. J. Dev. Biol.* 49: 653-664; Wang (2005) *Curr. Top. Dev. Biol.* 68: 227-261). Phytochromes are of particular ecological significance as shade detectors because of their ability to distinguish between energy rich sunlight and R-depleted shade light conditions which confers a competitive advantage to plants that can outgrow their neighbors (Smith and Whitelam (1997) *Plant Cell Environ.* 20: 840-844; Franklin and Whitelam (2005) *Ann. Bot.* (*Lond*) 96: 169-175; Izaguirre et al. (2006) *Proc. Natl. Acad. Sci. USA* 103: 7170-7174). However, phytochrome-mediated shade avoidance responses are counterproductive in high-density agricultural venues where they contribute to significant losses in crop yield (Kasperbauer (1987) *Plant Physiol.* 85: 350-354; Smith et al. (1990) *Plant Cell Environ.* 13: 73-78). Crop plant varieties exhibiting reduced shade avoidance responsiveness are therefore highly prized, and for this reason, shade avoidance mitigation has been the goal of conventional breeding programs, genetic engineering and even unconventional mulching approaches (Decoteau et al. (1989) *J. Am. Soc. Hort.* 114: 216-219; Smith (1994) *Sem. Cell Biol.* 5: 315-325; Ballaré and Casal (2000) *Field Crop Res.* 67: 149-160; Sawers et al. (2005) *Tr. Plant Sci.* 10: 138-143).

Smith and colleagues were among the first to successfully exploit phytochrome photobiology to engineer transgenic plants with reduced shade avoidance (Smith (1994) *Sem. Cell Biol.* 5: 315-325). Their investigations showed that the shade avoidance response could be strongly attenuated by overexpression of phyA. Recent studies have shown that overexpression of phyA in rice can potentially alleviate shade-dependent losses in grain yield in both greenhouse and field environments (Kong et al. (2004) *Mol. Breeding* 14: 35-45; Garg et al. (2006) *Planta* 223: 627-636). Unique amongst the phyA-E subfamilies of plant phytochromes, phyA is activated by FR-enriched shade/reflected light environments, while by contrast, the activities of the phyB-E photoreceptors are strongly inhibited by shade conditions. Since phyA photoactivation not only promotes its own degradation but also leads to repression of its own transcription (Quail (1984) *Tr. Biochem. Sci.* 9: 450-453; Lissemore and Quail (1988) *Molecular and Cellular Biology* 8: 4840-4850), shade avoidance mitigation by ‘light-labile’ phyAs requires elevated expression under control of strong constitutive promoters.

By comparison with studies using light-labile phyA, reports on the use of light stable phytochromes (i.e. phyB-E) to regulate photomorphogenesis in plants are few in number. One notable example is the demonstration that phyB expression can suppress the inhibition of potato tuberization observed at high densities (Boccalandro et al. (2003) *Plant Physiol.* 133: 1539-1546). Like the phyA studies however, these investigations utilized a strong constitutive promoter to drive the expression of phyB in transgenic plants. The use of dominant, constitutively active alleles of a “light-stable” phytochrome (i.e. phyB-E) is conceptually preferable to this approach, since such alleles may not require ectopic overexpression. However, forward genetic approaches have so far failed to identify gain-of-function mutants of a light-stable phytochrome in spite of robust methods for their identification. Since the signaling activity of all phytochromes is intimately dependent on its covalently linked linear tetrapyrrole (bilin) chromophore, whose photochemical isomerization initiates a conformational change of the associated protein scaffold, assembly-competent phytochrome mutants that are constitutively active may be mutually exclusive. The vast majority of phytochrome mutations so far identified have been loss-of-function alleles, with the few reported gain-of-function alleles exhibiting enhanced light-sensitivity or enhanced stability rather than light-independent constitutive activity (Weller et al. (2004) *Plant Physiol.* 135: 2186-2195; Dieterle et al. (2005) *Plant J.* 41: 146-161); for a list of phy mutant alleles see Table S2 in ref (Rockwell et al. (2006) *Ann. Rev. Plant Biol.* 57: 837-858).

The inability to isolate constitutively active alleles of phytochromes might also reflect the complexity of phytochrome molecular signaling pathways. In this regard, genetic tagging experiments using green fluorescent protein (GFPs) and its derivatives demonstrate that the photoregulatory activity of phytochrome depends on its subcellular localization (Nagatani (2004) *Curr. Opin. Plant Biol.* 7: 708-711). These studies confirm earlier studies that show the inactive red light-absorbing Pr form of phytochrome is predominantly localized in the cytoplasm, while photoactivation to the far-red light-absorbing Pfr form initiates its translocation to the nucleus and the formation of nuclear bodies (Kircher et al. (1999) *Plant Cell* 11: 1445-1456; Yamaguchi et al. (1999) *J. Cell Biol.* 145, 437-445; Kircher et al. (2002) *Plant Cell* 14: 1541-1555; Chen et al. (2003) *Proc. Natl. Acad. Sci. USA* 100: 14493-14498). Phytochrome mutants that cannot translocate to the nucleus or that fail to form subnuclear bodies are signaling inactive (Chen et al. (2003) *Proc. Natl. Acad. Sci. USA* 100: 14493-14498; Huq et al. (2003) *Plant J.* 35: 660-664). Both translocation processes are dependent on recognition elements within the C-terminal regulatory domains of phytochromes (Chen et al. (2005) *Curr. Biol.* 15: 637-642). By contrast, it is the N-terminal photosensory domains that play the dominant role in phytochrome’s light-dependent interactions with transcription factors to regulate the expression of light responsive genes (Nagy and Schäfer (2002) *Ann. Rev. Plant Biol.* 53: 329-355; Matsushita et al. (2003) *Nature* 424: 571-574; Chen et al. (2004) *Ann. Rev. Genet.* 38: 87-117; Khanna et al. (2004) *Plant Cell* 16: 3033-3044). In view of this signaling complexity, it is not surprising that genetic studies have predominantly identified loss-of-function alleles of phytochromes, such as those that encode mutant photoreceptors with impaired light-mediated nuclear localization, reduced nuclear body formation or enhanced dark reversion, a light-independent process that effects the loss of the photoactivated form of the photoreceptor (see Table S2 in Rockwell et al. (2006) *Ann. Rev. Plant Biol.* 57: 837-858).

The present study was undertaken to test the phenotypic consequences of the mutagenesis of a conserved tyrosine residue ($Y^{GAF}$) in the bilin-binding GAF domains of the plant phytochromes, phyA and phyB. Originally identified by a directed evolution screen for fluorescent gain-of-function mutants of the cyanobacterial phytochrome 1 (Cph1) (Fischer and Lagarias, 2004), $Y^{GAF}$ mutants of plant phytochromes are also photochemically impaired, with tyrosine-for-histidine (YH) substitution mutants in particular exhibiting intense red fluorescence (Fischer et al. (2005) *Biochem. ACS* 44: 15203-15215). Contrary with the expected loss-of-function activity of these mutants, the present studies demonstrate that select $Y^{GAF}$ mutants of plant phytochromes possess light-independent signaling activity. Introduction of the $Y^{GAF}$H allele of phyB into the genomes of transgenic plants led to constitutive photomorphogenetic (COP) development in darkness, light-independent activation of gene expression and R/FR insensitivity. By comparison, transgenic plants expressing the YH allele of AtPHYA exhibited weak COP phenotypes, and a strong dominant-negative phenotype under FR light in wild-type genetic backgrounds. Comparative phenotypic analysis of transgenics plants expressing other $Y^{GAF}$ alleles of AtPHYB was also performed, revealing a critical role of this tyrosine residue in light-mediated signal transfer. Taken together with genetic evidence that these gain-of-function phenotypes are dependent on the production of the bilin chromophore, these studies not only provide insight into the molecular mechanism of phytochrome signaling, but also highlight a new family of dominant, gain-of-function alleles of light stable phytochromes that provide an effective tool to mitigate shade avoidance in any transformable plant species.

Results

The $Y^{GAF}$H Mutant of AtPHYB is a Dominant, Biologically Active Allele that can Complement phyB-deficient *Arabidopsis* Mutants.

To investigate the biological activity of $Y^{GAF}$ mutants of *Arabidopsis* phytochromes, we introduced cDNA constructs containing wild-type or $Y^{GAF}$ alleles of PHYA and PHYB under control of the strong constitutive CaMV 35-S promoter and genomic constructs containing wild-type or $Y^{GAF}$ alleles of phytochromes into Ler wild type, phytochrome-deficient and/or phytochrome chromophore-deficient genetic backgrounds of *Arabidopsis thaliana* L. (see FIG. 1 for T-DNA insert maps). In all cases, multiple transformant lines were selected (typically more than 5), from which the homozygous T3 lines shown in Table 2 were secured. Phenotypic data for representative plants lines for each construct are discussed below, with phenotypic data for all lines compiled below.

Figure 16:
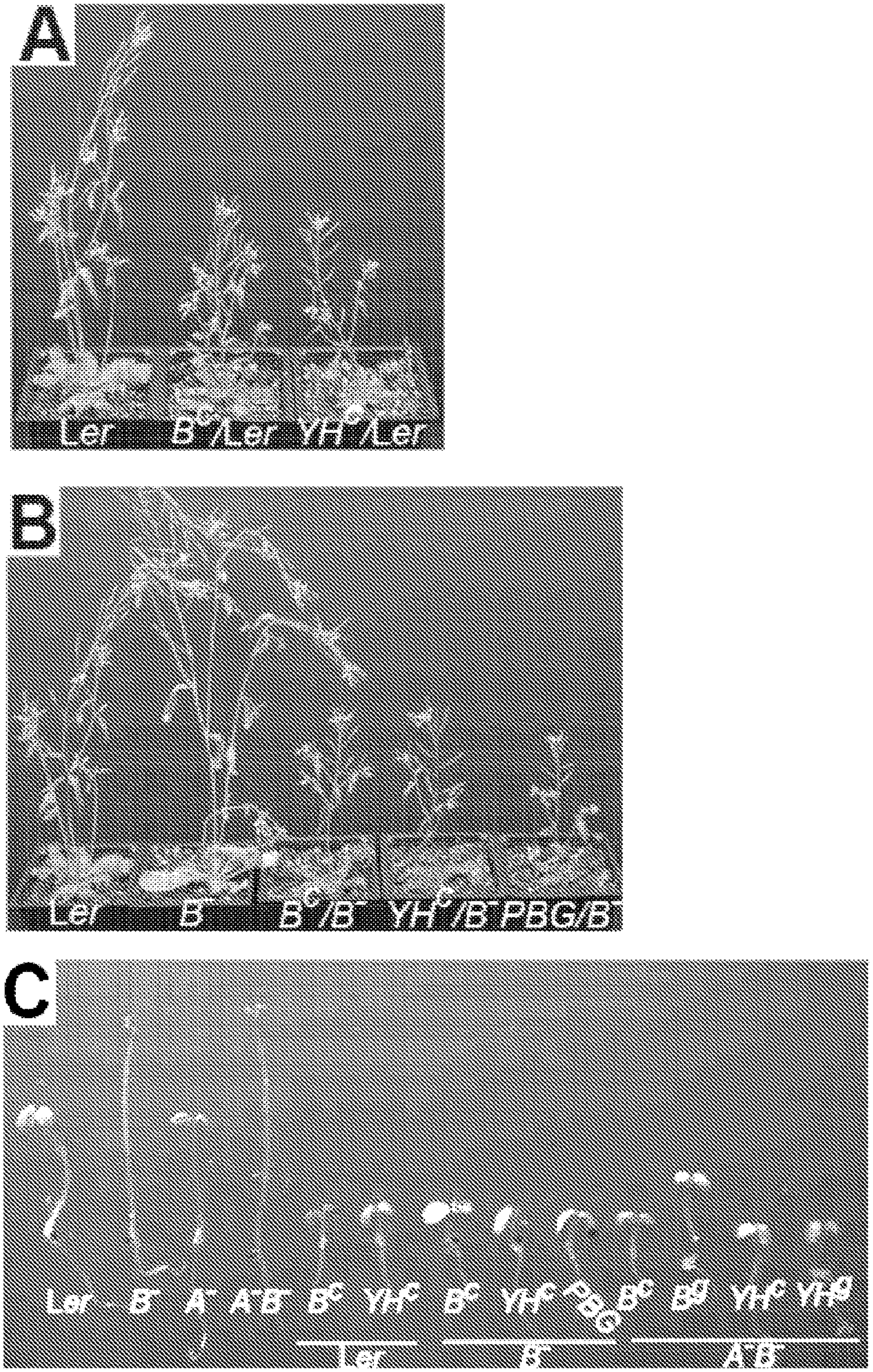
FIG. 16, panels A-E, shows that the YH mutant of AtPHYB (YHB) is functionally active in vivo. Panel A: Five-week-old transgenic Ler plants expressing AtPHYB wild type ($B^c$) and YHB mutant ($YH^c$) cDNA constructs grown under continuous white light ($W^c$) at the fluence rate of 50 μmol $m^{-2}$ $sec^{-1}$ are hyper-sensitive to light. Panel B: YHB expression rescues the Wc-grown phenotype of five-week-old phyB-5 null mutants ($B^-$) grown under the same conditions as panel A. Ler wild type, untransformed phyB-5 ($B^-$) and phyB-5 mutant lines transformed with the wild-type AtPHYB cDNA construct ($B^c$) or the AtPHYB-GFP chimera cDNA (PBG) (Yamaguchi et al., 1999) are shown for comparative purposes. Panel C: Hypersensitivity to 20 mol $m^{-2}$ $sec^{-1}$ continuous red light (Rc), observed for six-day-old seedlings expressing cDNA and genomic constructs of AtPHYB wild type ($B^c$ and $B^g$) or the YHB mutant ($YH^c$ and $YH^g$) grown on sucrose-free MS media, is independent of functional phyA and/or phyB photoreceptors. One representative line from each transformation of Ler wild type, phyB-5 ($B^-$) and phyA-201/phyB-5 ($A^-B^-$) is shown. For comparative purposes, Rc-grown untransformed parent and PBG/$B^-$ plant lines are shown. Panel D: Mean hypocotyl lengths (+/−s.d.; n=50) of Rc-grown seedlings shown in panel C. Panel E: Immunoblot analysis of PHYB protein level in wild type, phyB, phyA, phyA/phyB mutants, and YHB-expressing transgenic plants using monoclonal anti-PHYB B6-B3 antibodies. Total protein extracts (40 μg) from six-day-old dark-grown seedlings were loaded on each lane. Tubulin was used as loading control.

Initial studies focused on $YH^c$ and $YH^g$ transgenic plant lines that express cDNA and genomic constructs of the YH mutant of AtPHYB (i.e. Y276H), respectively. Since overexpression of wild-type AtPHYB confers enhanced white (W) and red (R) light sensitivity to transgenic plants (Wagner et al. (1991) *Plant Cell* 3: 1275-1288), we first compared the phenotypic consequence of $YH^c$ expression in both Ler wild type and phyB null mutant backgrounds with transgenic plants expressing wild-type alleles (FIG. 16, panels A-B). These investigations showed that the $YH^c$ allele conferred light-exaggerated phenotypes indistinguishable from those of transgenic plants over-expressing wild-type AtPHYB alleles. Hypocotyl and internode lengths of $YH^c$-expressing transgenic plants are considerably shorter than those of untransformed Ler wild-type plants and $YHB^c$ plants possess smaller rosettes under continuous white (Wc) light. Despite the poor photoactivity of YH mutants (Fischer et al. (2005) *Biochem. ACS* 44: 15203-15215), over-expression of $YH^c$ rescued the characteristic elongated phenotype of phyB null mutants as effectively as both the wild-type $B^c$ allele and the previously described wild-type AtPHYB-GFP (PBG) chimera (Yamaguchi et al. (1999) *J. Cell Biol.* 145, 437-445). These results indicate that the $Y^{GAF}$H mutant of AtPHYB is biologically active in light-grown plants.

Figure 27A:
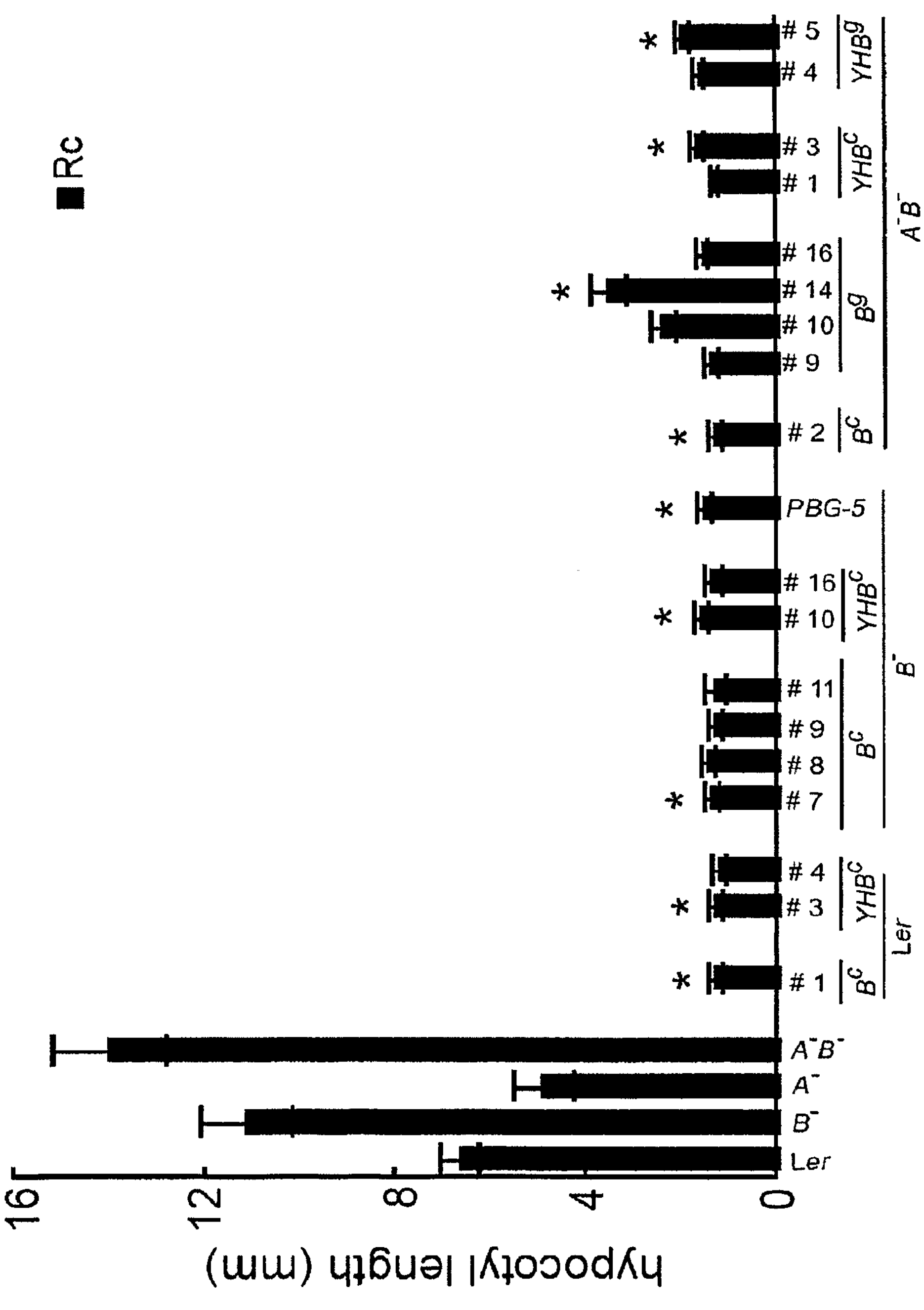
FIGS. 27A, 27B, and 27C show comparative hypocotyl length measurements and immunoblot analysis of multiple transgenic lines expressing wild type ($B^c$ or $B^g$) and YH mutant ($YHB^c$ or $YHB^g$) cDNA or genomic constructs in different genetic backgrounds grown under continuous red or in darkness.
Figure 27B:
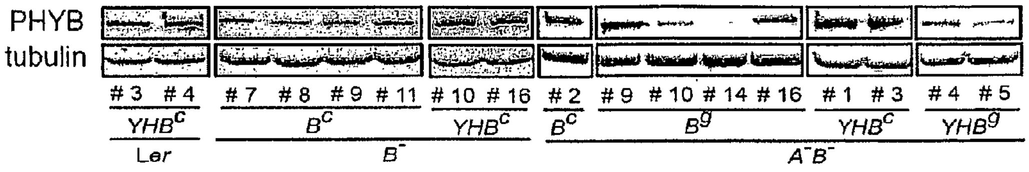
Figure 27C:
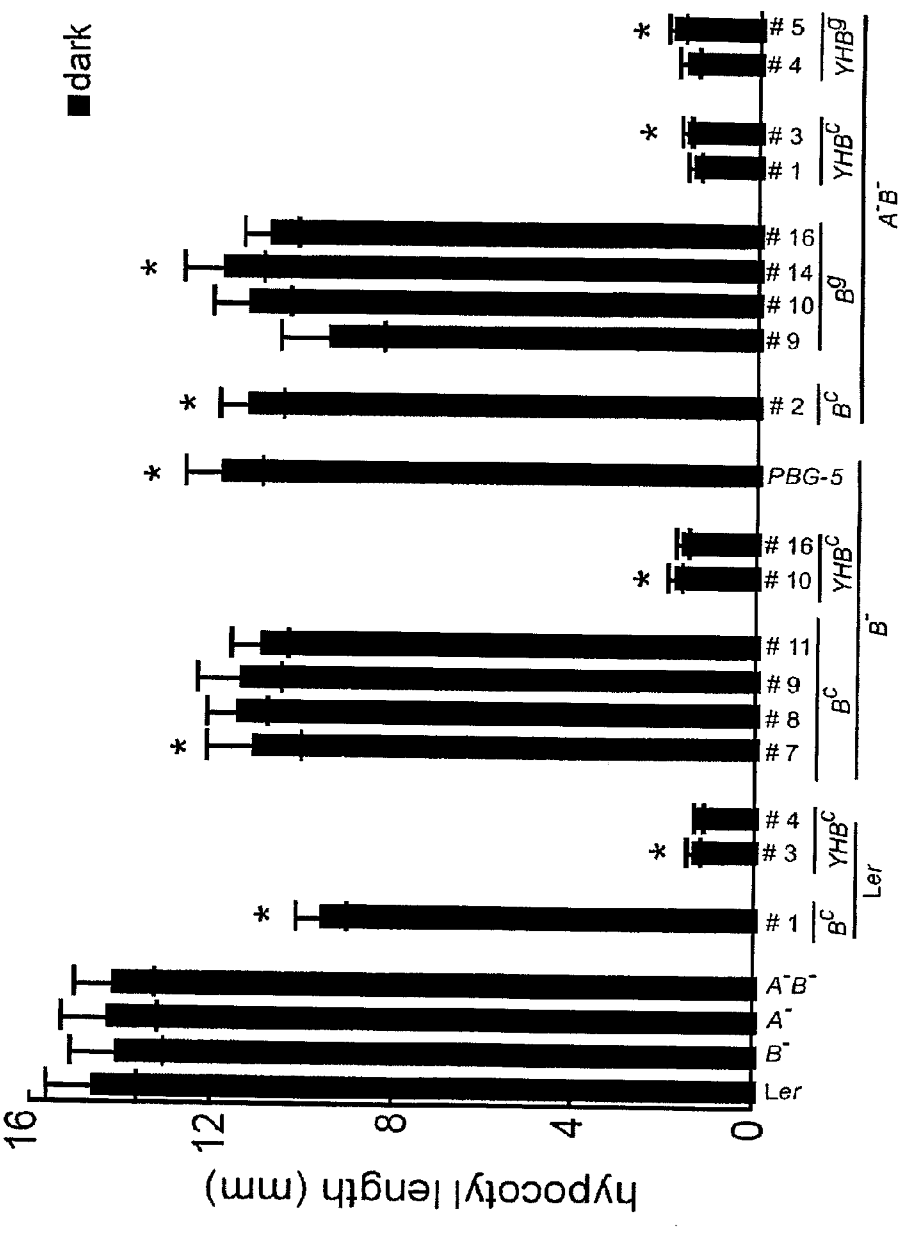

To distinguish phyB-specific responses from those of other photoreceptors (Furuya and Schäfer (1996) *Tr. Plant Sci.* 1: 301-307), we compared the phenotypes of YH- and wild-type PHYB-expressing transgenic lines grown under continuous red (Rc) light. For these experiments, we compared plant lines in which cDNA and genomic constructs were introduced into Ler wild type, phyB-5 single mutant ($B^-$) and phyA-201/phyB-5 double mutant ($A^-B^-$) backgrounds (FIG. 16, panels C-D and FIG. 27, panels A-B). These investigations show that overexpression of $YH^c$, wild type $B^c$ or PBG alleles all strongly inhibit hypocotyl growth under Rc regardless of the genetic background. The elongated hypocotyl phenotypes of Rc-grown $B^-$ and $A^-B^-$ seedlings are also strongly suppressed by expression of the $YH^g$ allele despite the near wild-type levels of phyB protein production (FIG. 16, panel E). Interestingly, the $YH^g$-derived photoreceptor appears to be more active than the wild-type $B^g$-derived protein as evidenced by the greater suppression of hypocotyl growth by the $YH^g$ allele in the $A^-B^-$ background. Taken together, these results indicate that YHB is a functional phyB photoreceptor.

Dark-Grown YHB-Expressing Transgenic Plants Exhibit Constitutive Photomorphogenesis.

Figure 17:
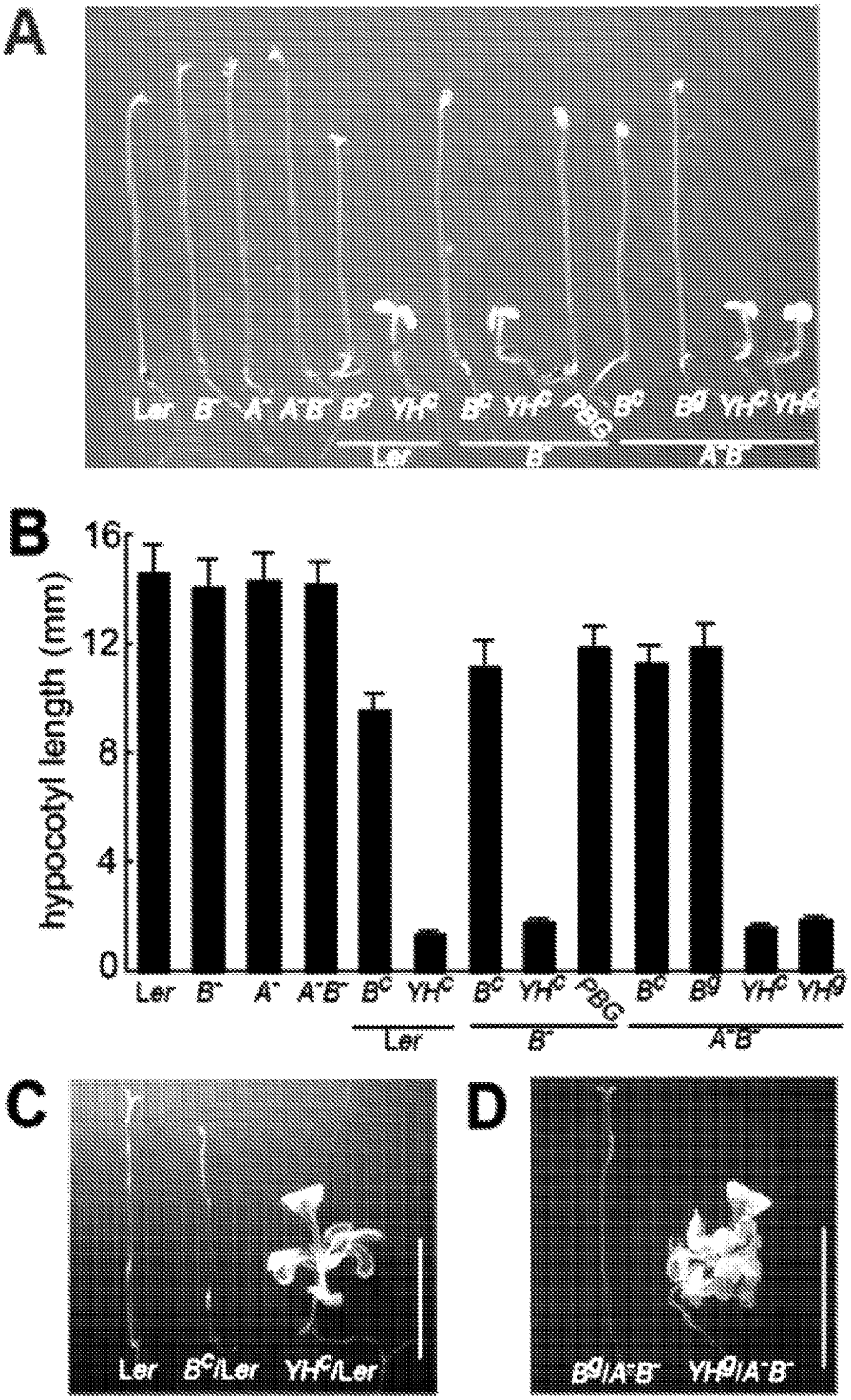
FIG. 17, panels A-D, shows constitutive photomorphogenic (COP) phenotypes of YHB-expressing transgenic plants. Panel A: Six-day-old dark-grown seedlings expressing $YH^c$ and $YH^g$ alleles of AtPHYB exhibit constitutive photomorphogenesis on sucrose-free MS media. Genotype abbreviations are those in FIG. 16. Panel B: Mean hypocotyl lengths (+/−s.d.; n=50) of dark-grown seedlings shown in panel A. Panel C: Four-week-old dark-grown Ler plants expressing $YH^c$ exhibit light-grown development in darkness on MS medium containing 1% (w/v) sucrose. Shown for comparison are untransformed Ler and $B^c$/Ler transgenic plant lines. Panel D: Six-week-old dark-grown phyA/phyB double mutants that express the $YH^g$ transgene exhibit light-grown development in darkness on 1% sucrose-containing MS media. For panels C and D, scale bars=1 cm.

Flowering plants grown in darkness etiolate—an adaptive developmental program known as skotomorphogenesis characterized by rapid hypocotyl/mesocotyl/epicotyl elongation growth, repression of hook opening, cotyledon/leaf expansion, as well as altered plastid development (Von Arnim and Deng (1996) *Plant Mol. Biol.* 47: 215-243). Etiolation is designed to facilitate emergence from soil until sufficient light is available for photoautotrophic growth. Although phytochromes are critical photosensors that regulate deetiolation of developing seedlings following skotomorphogenesis, phyA, phyB and phyA/phyB null mutants etiolate normally, demonstrating that these phytochromes do not actively repress photomorphogenesis in darkness (Smith et al. (1997) *Plant Physiol.* 114, 637-641). Nor does phytochrome overexpression affect etiolation, since dark grown seedlings overexpressing phytochromes are indistinguishable from wild type and null mutants (Smith (1994) *Sem. Cell Biol.* 5: 315-325). For this reason, it was surprising to observe that transgenic plants expressing the YH allele of AtPHYB develop in complete darkness as if they are grown in light (FIG. 16 and FIG. 27, panel C). These constitutively photomorphogenic (COP) phenotypes consist of inhibition of hypocotyl elongation, pronounced hood opening and cotyledon expansion—a growth and development phenotype that starkly contrasts with the observed skotomorphogenetic development of dark-grown Ler wild type, phyA, phyB and phyA/phyB null mutants, as well as all transgenic lines expressing the wild-type $B^c$ or PBG alleles (FIG. 17).

In T2 generations, dark-grown seedlings of multiple independent transformants of both $YH^c$ and $YH^g$ alleles displayed COP phenotypes regardless of their genetic backgrounds. For $YH^c$ transformations, we observed 6 of 9 COP segregants in Ler, 16 out of 18 in phyB-5 ($B^-$), and 7 out of 8 in phyA-201/phyB-5 ($A^-B^-$) backgrounds. For transformation of the $YH^g$ allele into the $A^-B^-$ background, COP phenotypes were observed in 8 of 8 transformants. Segregation analyses of heterozygous lines established that YH is a dominant allele of AtPHYB; one copy of YH proved sufficient to confer COP phenotypes in all genetic backgrounds analyzed (data not shown). These results indicate that, not only is YH a dominant gain-of-function allele, but that its gain-of-function activity is not affected by the absence/presence of functional wild-type PHYB or PHYA alleles. The observation that genomic $YH^g$ allele promotes light-independent photomorphogenesis also discounts the possibility that the COP phenotype is a consequence of ectopic expression of the mutant phyB photoreceptor or the elevated expression of the YHB mutant protein. $YH^c$-expressing seedlings continued to develop true leaves when sucrose is present as a carbon source in the medium (FIG. 17, panels C-D). Under the same conditions, seedlings expressing wild-type PHYB alleles showed arrested development with very long hypocotyls, unexpanded cotyledons and no development of true leaves (FIG. 17, panels C-D). Taken together, these results indicate that the YH allele encodes a constitutively active phytochrome mutant that does not require light for activation.

Bilin Chromophore is Required for the Gain-of-Function Activity of the YHB Mutant.

Figure 18:
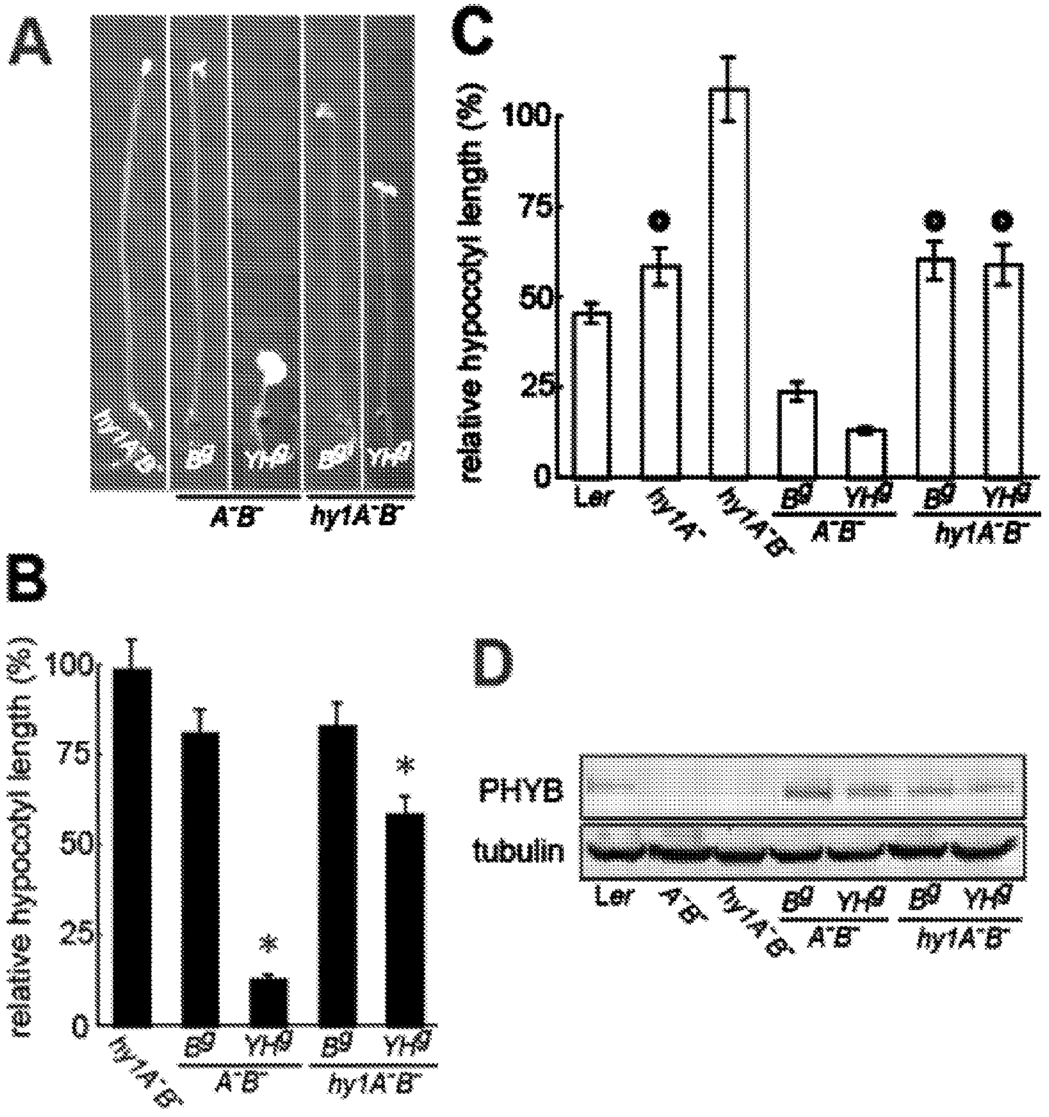
FIG. 18, panels A-D, shows that phytochrome chromophore biosynthesis is required for the gain-of-function activity of YHB. Panel A: YHB-dependent hypocotyl growth inhibition of six-day-old dark-grown transgenic plants in sucrose-free media is greatly suppressed in the bilin-deficient hy1/phyA/phyB triple mutant background. Genotype abbreviations are the same as in FIG. 16. Panel B: Relative hypocotyl length of dark-grown seedlings shown in panel A normalized to that of Ler shows the statistically significant activity of YHB in chromophore-replete phyA/phyB and bilin-deficient hy1/phyA/phyB backgrounds (marked by asterisks). Value=mean+/−s.d. (n=50). Panel C: Relative hypocotyl length of seedlings grown on sucrose-free media under 20 mol $m^{-2}$ $sec^{-1}$ continuous red (Rc) reveals that the leakiness of the hy1-1 mutation is responsible for partial complementation of the hy1/phyA/phyB triple mutant by both wild-type $B^c$ and $YH^c$ mutant transgenes. Mean hypocotyl lengths (+/−s.d.; n=50) are normalized to those of dark-grown Ler seedlings. Note that the shorter hypocotyl lengths of hy1/phyA, $B^g$/hy1/phyA/phyB and $YH^g$/hy1/phyA/phyB plants (marked with dark circles) compared with the hy1/phyA/phyB parent line indicate that sufficient bilin chromophore is present in the hy1 mutant background to maintain significant signaling activity of phyB and YHB, respectively. Panel D: Immunoblot analysis of PHYB protein level was performed as in FIG. 16.
Figure 28:
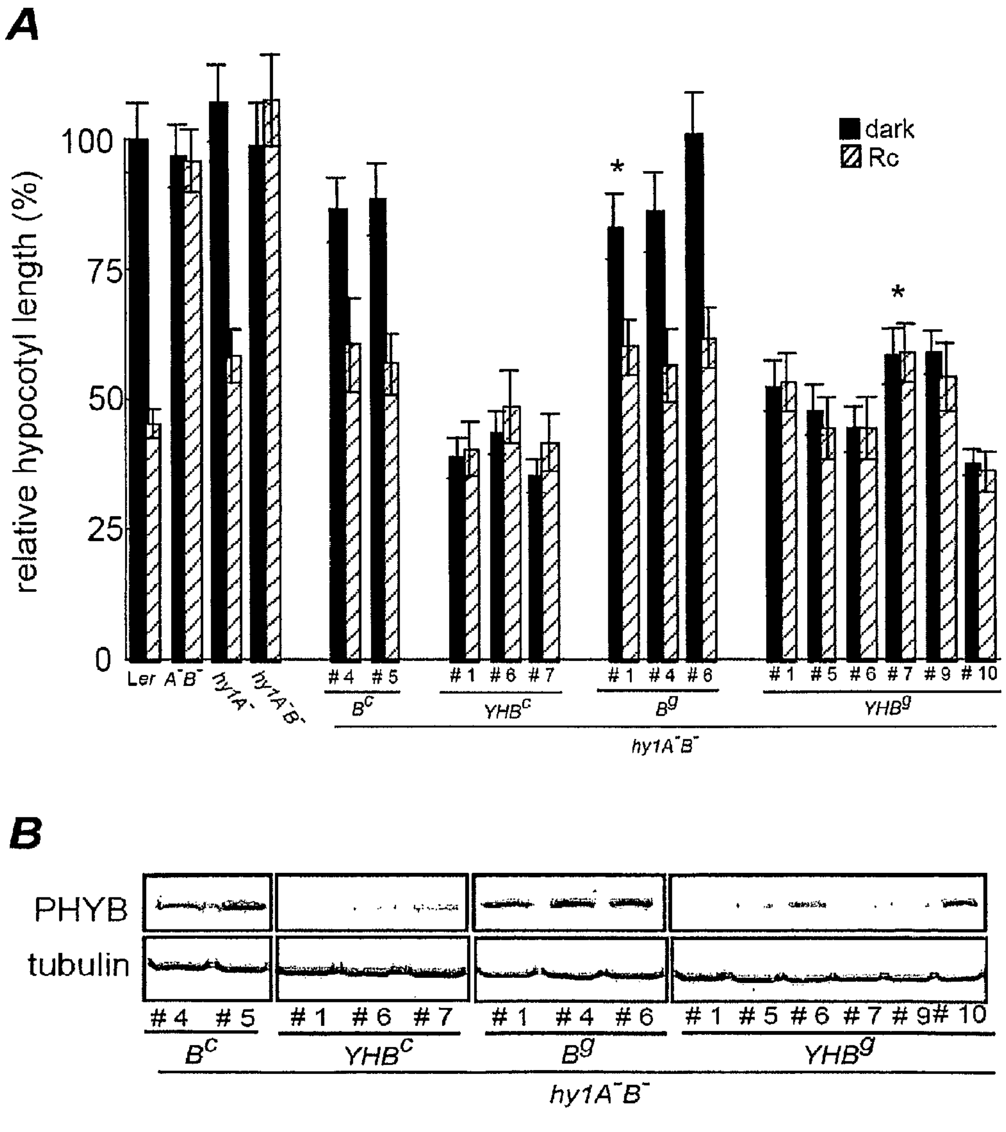
FIG. 28, panels A and B show comparative hypocotyl length measurements and immunoblot analysis of multiple transgenic lines expressing wild type PHYB ($B^c$ or $B^g$) and YHB mutant ($YHB^c$ or $YHB^g$) cDNA or genomic constructs in phytochrome chromophore-deficient genetic backgrounds grown under continuous red or in darkness. Panel A: Relative hypocotyl length (+/−s.d.; n=50) of six-day-old seedlings expressing wild type PHYB or YHB mutant alleles in the hy1-1/phyA-201/phyB-5 ($hy1A^-B^-$) genetic background grown in darkness or continuous red light (Rc) at a fluence rate of 20 μmol $m^{-2}$ $sec^{-1}$. Asterisks indicate the representative lines shown in FIG. 18. The hypocotyl length of dark-grown Ler seedlings was set as 100%. Genotype and transgene abbreviations are as in FIG. 27 or as follows: $hy1A^-$: hy1-1/phyA-201, $hy1A^-B^-$: hy1-1/phyA-201/phyB-5. Panel B: PHYB protein levels were determined as in FIG. 27.

The bilin chromophore of phytochromes is essential for light signaling (Koornneef and Kendrick (1994) pp. 601-628 In: *Photomorphogenic Mutants of Higher Plants. In Photomorphogenesis in Plants*, R. E. Kendrick and G. H. M. Kronenberg, eds (Dordrecht: Kluwer Academic Publishers); Terry (1997) *Plant Cell Environ.* 20: 740-745; Montgomery et al. (2001) *Plant Physiol.* 125: 266-277; Sawers et al. (2002) *Plant Physiol.* 130: 155-163). To test the hypothesis that bilin chromophore is required for the gain-of-function activity of the YHB mutant, we compared the phenotypic consequence of introducing $YH^g$ and $B^g$ alleles into both bilin-deficient hy1-1/phyA-201/phyB-5 and bilin-producing phyA-201/phyB-5 mutant backgrounds. These analyses show that hy1-1, a null allele that is deficient in the bilin chromophore biosynthetic enzyme heme oxygenase (Muramoto et al. (1999) *Plant Cell* 11: 335-347), strongly suppressed the gain-of-function activity of the $YH^g$ allele as measured by seedling hypocotyl growth (FIG. 18 and FIG. 28). Although dark-grown $YHB^g$ transgenics in hy1/phyA/phyB backgrounds possessed shorter hypocotyls than the untransformed hy1/phyA/phyB parent, $YH^g$ transgenics were significantly more etiolated in bilin-deficient hy1/phyA/phyB backgrounds than $YH^g$ transgenics in bilin-producing phyA/phyB backgrounds that exhibited a strong COP phenotype (FIG. 18, panels A-B). By contrast, this phenomenon was not observed in hy1/phyA/phyB and phyA/phyB backgrounds transformed with the wild-type $B^g$ allele—both of which showed normal skotomorphogenesis. To test whether the incomplete suppression of the $YH^g$-dependent COP phenotype by hy1 reflected partial synthesis of bilin chromophore via one of the other three heme oxygenases in *Arabidopsis* (Davis et al. (2001) *Plant Physiol.* 126: 656-669; Muramoto et al. (2002) *Plant Physiol.* 130: 1958-1966; Emborg et al. (2006) *Plant Physiol.* 140: 856-868), we performed an additional set of phenotypic comparisons under Rc (FIG. 18, panel C). These experiments revealed that hy1 does not fully eliminate the light response as long as some PHYB protein is present—a result that is consistent with residual chromophorylation of PHYB in the hy1 mutant background. This conclusion is supported by the Rc-dependent hypocotyl growth inhibition of hy1/phyA seedlings that is roughly 66% of wild-type Ler under the same fluence rate used for these experiments (FIG. 18, panel C; compare dark-grown Ler with Rc-grown Ler and hy1/phyA plants). Moreover, the hypocotyl lengths of hy1/phyA plants under Rc are indistinguishable from those of hy1/phyA/phyB mutants that had been transformed with either wild-type $B^g$ or $YH^g$ mutant alleles (FIG. 18, panel C; compare Rc-grown Ler with hy1/phyA/phyB plants transformed with $B^g$ or $YH^g$). The latter suggests that the residual Rc-dependent activity of the $B^g$-derived wild-type phyB in the hy1/phyA/phyB background is nearly identical with the light-independent activity of the $YH^g$-derived phyB mutant in the same genetic background. Taken together, these results indicate that bilin chromophore is required for the light-independent signaling activity of the YHB mutant.

YHB Constitutively Localizes to the Nucleus, Forms Nuclear Bodies and Activates the Expression of Light-Regulated Genes in Both Light and Darkness.

Figure 19:
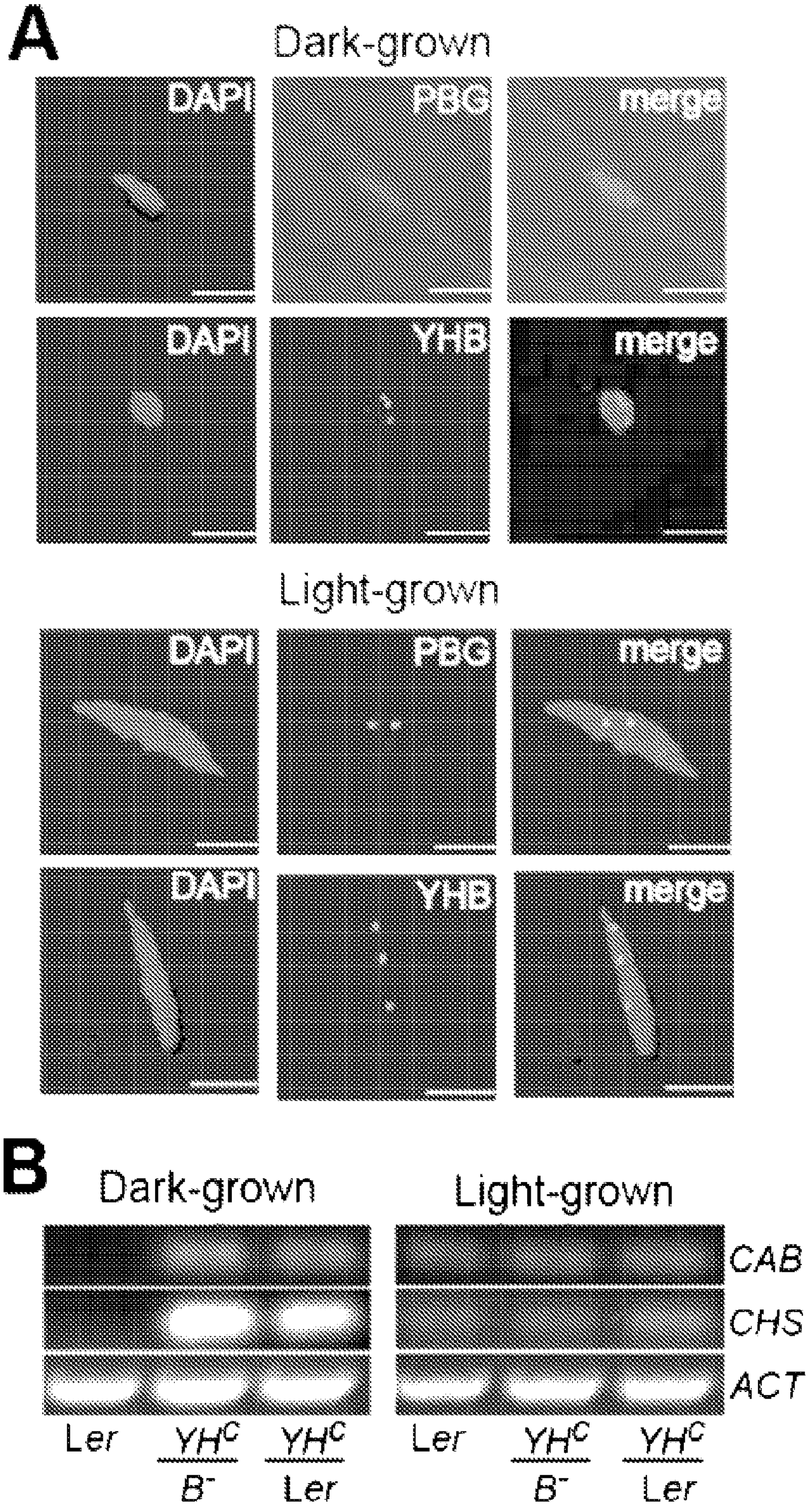
FIG. 19, panels A and B, show that YHB localizes to the nucleus, forms nuclear bodies (speckles) and activates the expression of light regulated genes in darkness. Panel A: Comparative subcellular localization of wild-type AtPHYB-GFP (PBG) chimera and YHB mutant proteins in five-day-old dark- and continuous light-grown (80 μmole $m^{-2}$ $sec^{-1}$) seedlings by fluorescence confocal microscopy reveals the constitutive localization of YHB in the nucleus that contrasts with the light-dependent localization of PBG. PBG was visualized using a GFP Ex/Em protocol, YHB visualized using a Texas Red Ex/Em protocol and nuclei were identified by a DAPI Ex/Em protocol. Merged images represent overlapping DAPI and GFP images (for PBG) or overlap of the DAPI with and Texas Red images (for YHB). Panel B: Light-independent expression of CAB and CHS transcripts were observed in dark-grown YHB plants by RT-PCR. Ethidium bromide stained agarose gels contain 10 μL of PCR product per lane. ACT transcript levels are shown as a RNA template control.

The subcellular localization of phytochrome is tightly correlated with its photoregulatory activity. The red absorbing Pr form of phytochromes is both synthesized and accumulates in the cytoplasm; however, following photoactivation, the far-red absorbing Pfr form migrates into the nucleus (Yamaguchi et al. (1999) *J. Cell Biol.* 145, 437-445; Kircher et al. (2002) *Plant Cell* 14: 1541-1555). Since cytoplasmically tethered phytochrome is functionally inactive even in the presence of light (Huq et al. (2003) *Plant J.* 35: 660-664), and nuclear-localized phytochrome requires light activation for regulatory function (Matsushita et al. (2003) *Nature* 424: 571-574), it is clear that nuclear-localized Pfr is needed for full signaling activity. Once in the nucleus, phytochrome accumulates in nuclear bodies or speckles, and at least for phyB, the size of the nuclear body depends on continuous Pfr generation by light (Chen et al. (2003) *Proc. Natl. Acad. Sci. USA* 100: 14493-14498). Moreover, the observations that nuclear body formation correlates with hypocotyl growth inhibition and that phyB alleles deficient in speckle formation are poorly active support the conclusion that nuclear body formation plays a direct role in signal transduction (Chen et al. (2005) *Curr. Biol.* 15: 637-642). Because of the constitutive signaling activity of the YHB mutant, we tested whether light is required for its nuclear localization in $YH'$-expressing transgenic plants. Fortunately, YHB is strongly fluorescent (Fischer et al. (2005) *Biochem. ACS* 44: 15203-15215) so its localization could readily be monitored by fluorescence microscopy. By contrast with the light-dependent nuclear localization of PBG, a wild-type PHYB-GFP chimera used as a control (Yamaguchi et al. (1999) *J. Cell Biol.* 145, 437-445), YHB was nuclear localized in both dark- and light-grown plants (FIG. 19, panel A). The presence of red fluorescent nuclear bodies in dark-grown YHB transgenics clearly indicated that both nuclear translocation and nuclear body formation are light-independent, a result fully consistent with the constitutive signaling activity of YHB in darkness.

To further ascertain whether the COP phenotype of dark-grown YHB transgenics reflects mis-expression of light-regulated genes, RT-PCR analysis was performed for two well-studied light responsive genes, CHALCONE SYNTHASE (CHS) and CHLOROPHYLL A/B BINDING PROTEIN (CAB) (Quail (1991) *Ann. Rev. Genet.* 25: 389-409). By comparison with untransformed Ler wild type which requires light for measurable expression of either gene, YHB strongly activated expression of both genes in darkness regardless of the presence of a wild-type PHYB allele (FIG. 19, panel B). For light-grown plants, little difference was detected in the amount of CAB or CHS gene expression between Ler wild type and YH transformants. Taken together, the observed light-independent nuclear localization of the YHB holoprotein and mis-expression of light-regulated genes indicate that the YHB mutation bypasses both light-dependent signaling processes.

Other $Y^{GAF}$ Mutants of PHYB can Complement the phyB-deficient Phenotype of phyA/phyB Double Mutants.

Saturation mutagenesis of the $Y^{GAF}$ residue in the cyanobacterial phytochrome Cph1 has shown that, although this tyrosine residue is not essential for bilin attachment, it is critical for normal photochemistry (Fischer et al. (2005) *Biochem. ACS* 44: 15203-15215). Besides the intensely fluorescent $Y^{GAF}$H mutant of Cph1, three other amino acid substitutions (E, Q and W) similarly enhanced Cph1 fluorescence. By contrast, most other amino acid substitutions yielded poorly photoactive and nonfluorescent Cph1 holoproteins with more cyclic, deprotonated bilin chromophores (Id.). The latter consisted of two classes—those $Y^{GAF}$ mutants with cyclic chromophores (TWLVFIK mutants) and those with 'partially-extended' chromophores (DMGNCA mutants). Unusually, the YR mutant possessed a high affinity for an endogenous porphyrin showing that the $Y^{GAF}$ residue plays a role in chromophore recognition. Since Cph1 and plant phytochromes exhibit the greatest similarity in their bilin binding pockets (Wagner et al. (2005) *Nature* 438: 325-331; Rockwell and Lagarias (2006) *Plant Cell* 18: 4-14), we expect the corresponding $Y^{GAF}$ substitution mutants of Cph1 and plant phytochromes to distribute into similar classes of spectrally altered holophytochromes. In this regard, preliminary studies have shown that the YQ and YI mutants of a truncated allele of AtPHYB yielded recombinant holoproteins with similar spectral properties to the corresponding Cph1 mutant, although to date the YRB apoprotein failed to bind any chromophore in the *E. coli* expression system used (Fischer et al. (2005) *Biochem. ACS* 44: 15203-15215) and data not shown).

Figure 20:
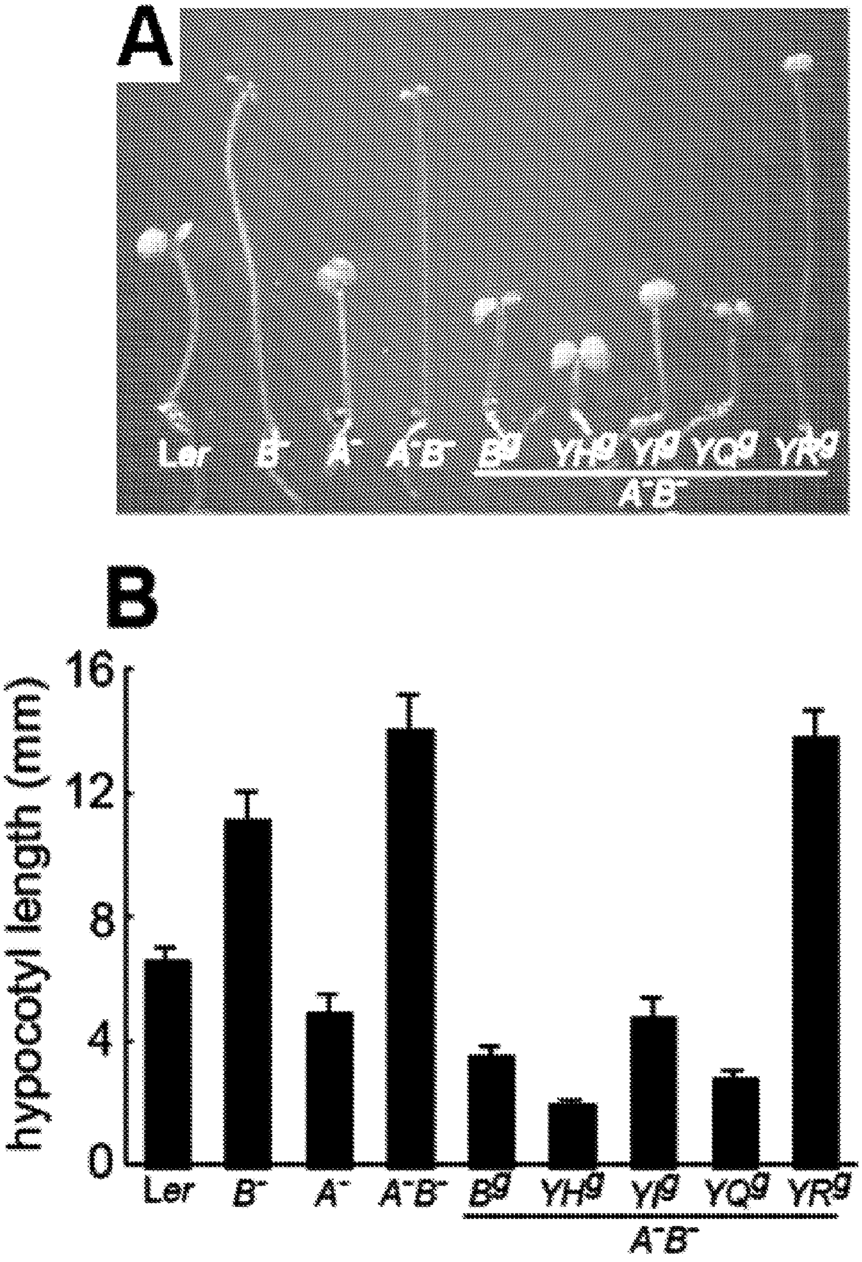
FIG. 20, panels A-D, provides a phenotypic analysis of other light-grown $Y^{GAF}$ mutants of phytochrome B that reveals both gain-of-function and loss-of-function activities. Panel A: Expression of $YI^g$ and $YQ^g$ alleles of AtPHYB, but not the $YR^g$ allele, rescues the phyB deficient long hypocotyl phenotype of $A^-B^-$ double mutants grown on sucrose-free media for six days under 20 μmol $m^{-2}$ $sec^{-1}$ Rc. One representative line from each transformation is shown and genotype abbreviations are those in FIG. 16. Panel B: Mean hypocotyl lengths (+/−s.d.; n=50) of Rc-grown seedlings shown in panel A. Panel C: Immunoblot analysis of PHYB protein levels was performed as in FIG. 16. Panel D: Comparative morphology of five-week-old plants grown under continuous white light at the fluence rate of 50 mol $m^{-2}$ $sec^{-1}$ reveals that $YH^g$, $YI^g$ and $YQ^g$ alleles of AtPHYB complement the phyB-deficiency of the $A^-B^-$ mutant, while $YR^g$ does not.
Figure 29:
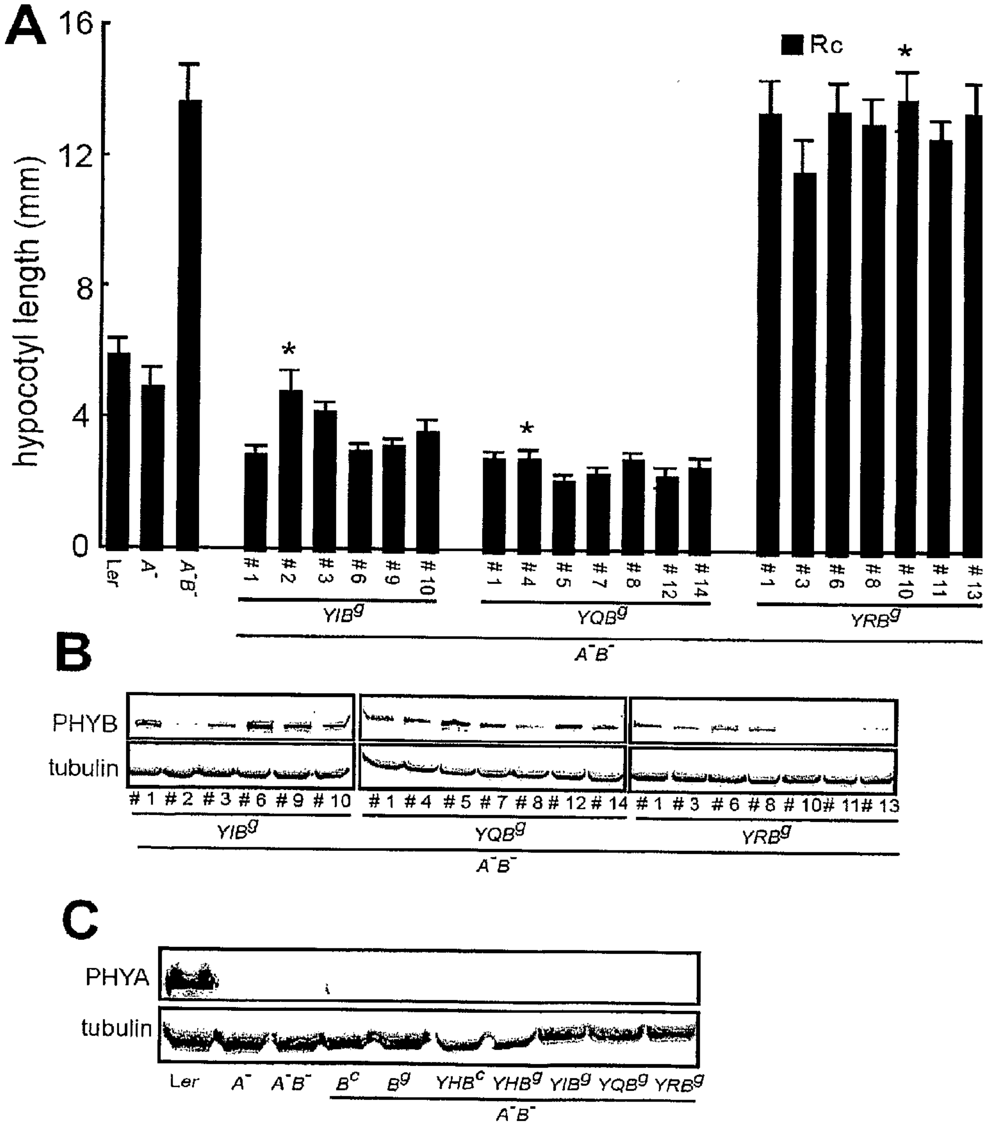
FIG. 29, panels A-E, shows comparative hypocotyl length measurements and immunoblot analysis of multiple transgenic lines expressing various $Y^{GAF}$ mutant alleles of phytochrome B in different genetic backgrounds grown under continuous red, far-red or darkness. Panel A: Mean hypocotyl length (+/−s.d.; n=50) of six-day-old wild type, phytochrome-deficient phyA-201 ($A^-$) and phyA-201/phyB-5 ($A^-B^-$) mutants and transgenic $A^-B^-$ mutants expressing genomic constructs of the Y276I-PHYB ($YIB^g$), Y276Q-PHYB ($YQB^g$) Y276R-PHYB ($YRB^g$) mutants grown under continuous red light (Rc) at fluence rate of 20 μmol $m^{-2}$ $sec^{-1}$. Asterisks indicate the representative lines shown in FIGS. 20-22. Panel B: PHYB protein levels in six-day-old dark-grown transgenic seedlings determined as in FIG. 27. Panel C: PHYA protein levels in six-day-old dark-grown transgenic seedlings (40 μg total protein per lane) were determined using monoclonal anti-PHYA O73D as the primary antibody. Panel D: Mean hypocotyl length (+/−s.d.; n=50) of six-day-old wild-type PHYB- and $Y^{\prime AF}$-expressing seedlings grown in complete darkness. Asterisks indicate the representative lines shown in FIGS. 20-22. Panel E: Mean hypocotyl length (+/−s.d.; n=50) of six-day-old PHYB- and $Y^{\prime AF}$-expressing seedlings grown under continuous far-red (FRc) at a fluence rate of 20 mol $m^{-2}$ $sec^{-1}$. Asterisks indicate the representative lines shown in FIGS. 20-22. Genotype and transgene abbreviations are as in FIGS. 27 and 28.

To more fully compare the phenotypic consequences of the different classes of $Y^{GAF}$ mutant of PHYB in planta, we transformed phyA/phyB null mutants with genomic $YQ^g$, $YI^g$ and $YR^g$ alleles of PHYB which encode substitution mutants predicted to have fluorescent/extended, nonfluorescent/cyclic and porphyrin chromophores, respectively. Homozygous lines were selected and grown under Rc for phenotypic comparison with untransformed Ler wild type, phyA, phyB and phyA/phyB controls as well as with phyA/phyB transformants harboring wild-type $B^g$ and $YH^g$ mutant alleles of PHYB (FIG. 20, panels A-B and FIG. 29). These investigations show that both $YQ^g$ and $YI^g$ alleles rescued the phyB-deficiency of the phyA/phyB mutant; both restored Rc-mediated hypocotyl growth inhibition and cotyledon expansion seen in Ler wild type. By contrast, the $YR^g$ allele proved functionally inactive, failing to complement the phyA/phyB mutant under the same experimental conditions. Since $Y^{GAF}$ mutant protein was present in all transgenic lines, albeit at slightly different levels (FIG. 20, panel C), the observed phenotypic complementation under Rc demonstrates signaling activity for all $Y^{GAF}$ mutants except for YRB. Phenotypic comparisons of five-week-old adult plants grown under Wc were fully consistent with the Rc-grown seedling experiments (FIG. 20, panel D). In this regard, the $YH^g$ and $YQ^g$ alleles of PHYB proved more effective than $YI^g$ in complementing the elongated internode phenotype of the phyA/phyB mutant in Wc and the $YR^g$ allele similarly proved inactive under Wc. These data demonstrate that, although the $Y^{GAF}$ residue is critical for phytochrome's photochemical activity, the $Y^{GAF}$ residue of PHYB can be replaced with other amino acids that considerably inhibit the efficiency of its photoactivation yet still retain significant regulatory function.

Figure 21:
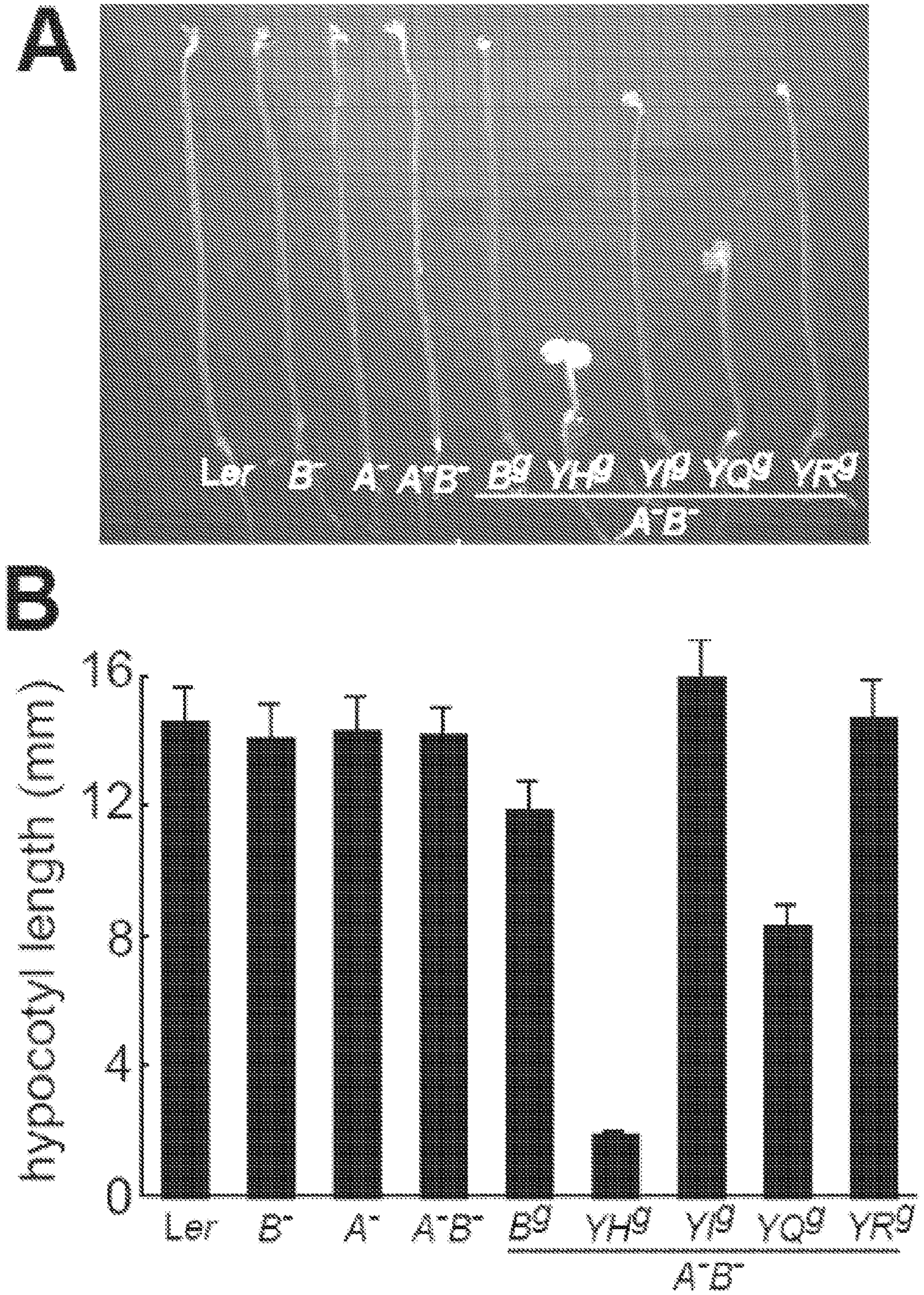
FIG. 21, panels A-D, shows that YQB is a constitutively active phytochrome, while YIB requires light for function and YRB is inactive. Panel A: Comparative phenotypic analysis of various lines expressing $Y^{GAF}$ alleles of AtPHYB reveals that other than the YHB mutant, only the YQB mutant confers a COP phenotype to six-day-old dark-grown seedlings on sucrose-free MS media. One representative line from each transformation is shown and genotype abbreviations are those in FIG. 16. Panel B: Mean hypocotyl lengths (+/−s.d.; n=50) of six-day-old dark-grown seedlings shown in panel A. Panel C: Comparative fluence response curves for hypocotyl growth indicate that YHB-mediated growth suppression is Rc light-independent, while the growth suppression activities of YQB and YIB are fluence rate dependent and YRB is inactive. Each data point represents the mean of 50 seedlings +/−s.d. Panel D: Mean hypocotyl lengths (+/−s.d.; n=50) of six-day-old seedlings grown under 20 μmol $m^{-2}$ $sec^{-1}$ Rc or 8 h-Rc/16 h-dark photoperiods shows that the YIB mutant requires sustained illumination for full activity.

To test the light dependence of the complementing activity of the various $Y^{GAF}$ alleles of PHYB in the phyA/phyB double mutant background, we first examined the dark-grown phenotypes of all transgenic lines. $YQ^g$-expressing plants exhibited a COP phenotype when grown in darkness similar to, although not as pronounced as, plants expressing the $YH^g$ allele of PHYB (FIG. 21, panels A-B). By contrast, plants expressing the $YI^g$ or $YR^g$ alleles showed normal skotomorphogenesis, demonstrating that the YIB and YQB proteins are not constitutively active (FIG. 21, panels A-B; FIG. 29, panel C). The observation that the COP phenotype of $YQ^g$ plants was not as strong as that of $YH^g$ plants (i.e. compare hypocotyl lengths of $YQ^g$ and $YH^g$ in FIG. 21, panel B) suggests that YQB may not be as active as YHB. However, we cannot rule out differences in expression level/pattern to account for this observation.

To more fully characterize the light responsiveness of the $Y^{GAF}$ mutants of PHYB, fluence rate response measurements of hypocotyl growth were undertaken for seedlings grown under Rc. Since these experiments employed $Y^{GAF}$ transgenic lines in phyA/phyB genetic backgrounds that lack functional PHYA and PHYB alleles, the endogenous photoreceptors should not interfere with the measurement of $Y^{GAF}$ mutant activity. As shown in FIG. 21, panel C, these investigations revealed that YHB was fully active under all fluences of Rc, while no activity of the YRB mutant was measurable at any fluence rates of Rc. Hypocotyl lengths of dark-grown YHB seedlings were indistinguishable from those of seedlings exposed to any fluence rate of Rc, hence it appears that the constitutive gain-of-function activity of YHB is independent of red light.

The activities of YQB and YIB mutants were both strongly regulated by the Rc fluence rate similar to plants possessing wild-type PHYB alleles (FIG. 21, panel C). Indeed, the observed fluence rate dependent inhibition of hypocotyl growth revealed that YIB and YQB mutants are functional photoreceptors that require Rc illumination for full activity. Of the two mutants, only YQB was able to sustain constitutive photomorphogenesis in darkness. Since YQB seedlings are shorter than Ler wild type (as well as phyA/phyB mutants transformed with a wild-type $B^g$ allele) at all fluence rates of Rc, YQB appears to possess light-independent as well as light-dependent regulatory activities. By contrast, YIB is a less active phytochrome that may require continuous irradiation for sustained activation. To test this hypothesis, hypocotyl lengths of $Y^{GAF}$ seedlings grown under 8 h-Rc/1 6 h-dark cycles were compared with those grown under continuous Rc. These analyses showed that hypocotyl lengths of the YIB mutants were particularly sensitive to the two light regimes (FIG. 21, panel D). For YIB seedlings grown under 8 h-Rc/16 h-dark cycles, hypocotyls were about 50% longer than seedlings grown under continuous red light, which contrasts with a 20% difference for plants expressing a wild-type PHYB allele (i.e. Ler and $B^g$ plants). These results suggest that YIB requires sustained activation for full activity, potentially reflecting the enhanced dark reversion of its light-activated Pfr form. PhyB mutants with enhanced dark reversion have been previously described, many of which show reduced activity at low fluence rates of light (Elich and Chory (1997) *Plant Cell* 9: 2271-2280; Rockwell et al. (2006) *Ann. Rev. Plant Biol.* 57: 837-858).

Figure 22:
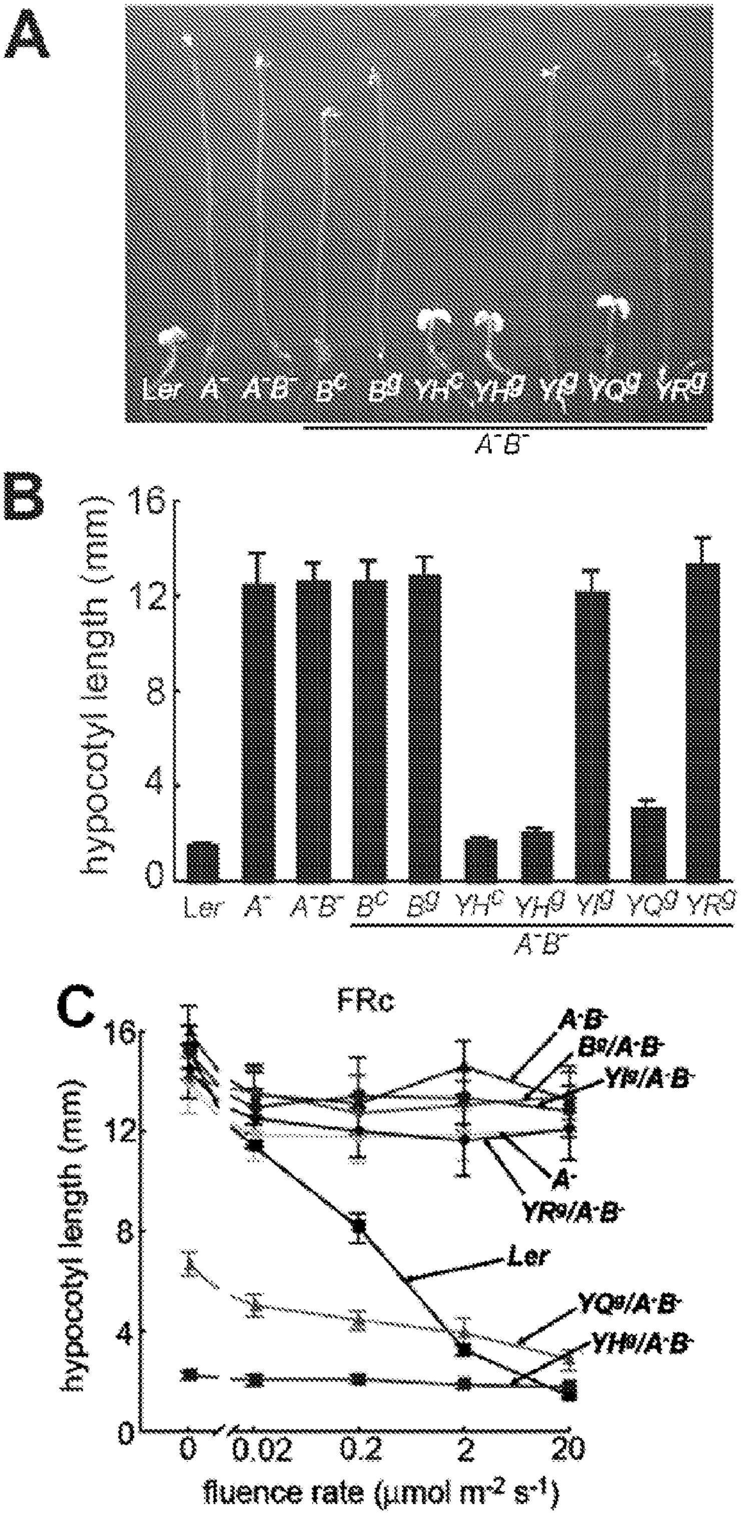
FIG. 22, panels A-C, shows that the activities of YHB and YQB are not inhibited by continuous far-red illumination. Panel A: Comparative analysis of seedling development of six-day-old plants grown under 20 μmole m−2 $sec^{-1}$ continuous far-red (FRc) show that YHB and YQB mutants exhibit significant activity—conditions that fail to activate wild-type phyB, YIB or YRB signaling. Panel B: Mean hypocotyl lengths (+/−s.d.; n=50) of six-day-old far-red light-grown seedlings shown in panel A. Panel C: Comparative fluence response curves for hypocotyl growth indicate that YHB-mediated growth suppression is FRc light-independent, while the growth suppression activity of YQB is both FRc light-independent and FRc light-dependent. FRc does not support the activation of wild-type PHYB, YRB and YIB. Each data point represents the mean of 50 seedlings +/−s.d.

To further characterize the light responsiveness of the $Y^{GAF}$ mutants, fluence response measurements of hypocotyl growth were also undertaken for seedlings grown under FRc, conditions that specifically activate phyA signaling (Furuya and Schäfer (1996) *Tr. Plant Sci.* 1: 301-307). Since the $Y^{GAF}$ mutants were introduced into phytochrome-deficient phyA/phyB backgrounds, such experiments should resolve whether the $Y^{GAF}$ mutations could alter the light specificity of PHYB signaling. These experiments indicate that both YHB and YQB alleles 'complement' the phyA/phyB double mutant under FRc, restoring strong FRc-dependent hypocotyl growth inhibition and cotyledon expansion responses (FIG. 22, panels A-B). By contrast, YIB and YRB alleles, both failed to complement the phyA/phyB double mutant in FRc. Since the YHB and YQB mutants possess constitutive signaling activities in darkness, this does not necessarily mean that these mutants are activated by FRc. However, the small but measurable FRc fluence rate dependence of the YQB mutant (FIG. 22, panel C) suggests that this mutant might possess the ability to sense FRc at elevated fluence rates. These experiments show that FRc irradiation does not reverse the constitutive activities of the gain-of-function YHB and YQB mutants—a result that contrasts with the strong inhibition of wild-type phyB activity by FR.

YHB- and YQB-Expressing Transformants Exhibit Light-Independent Seed Germination.

Figure 23:
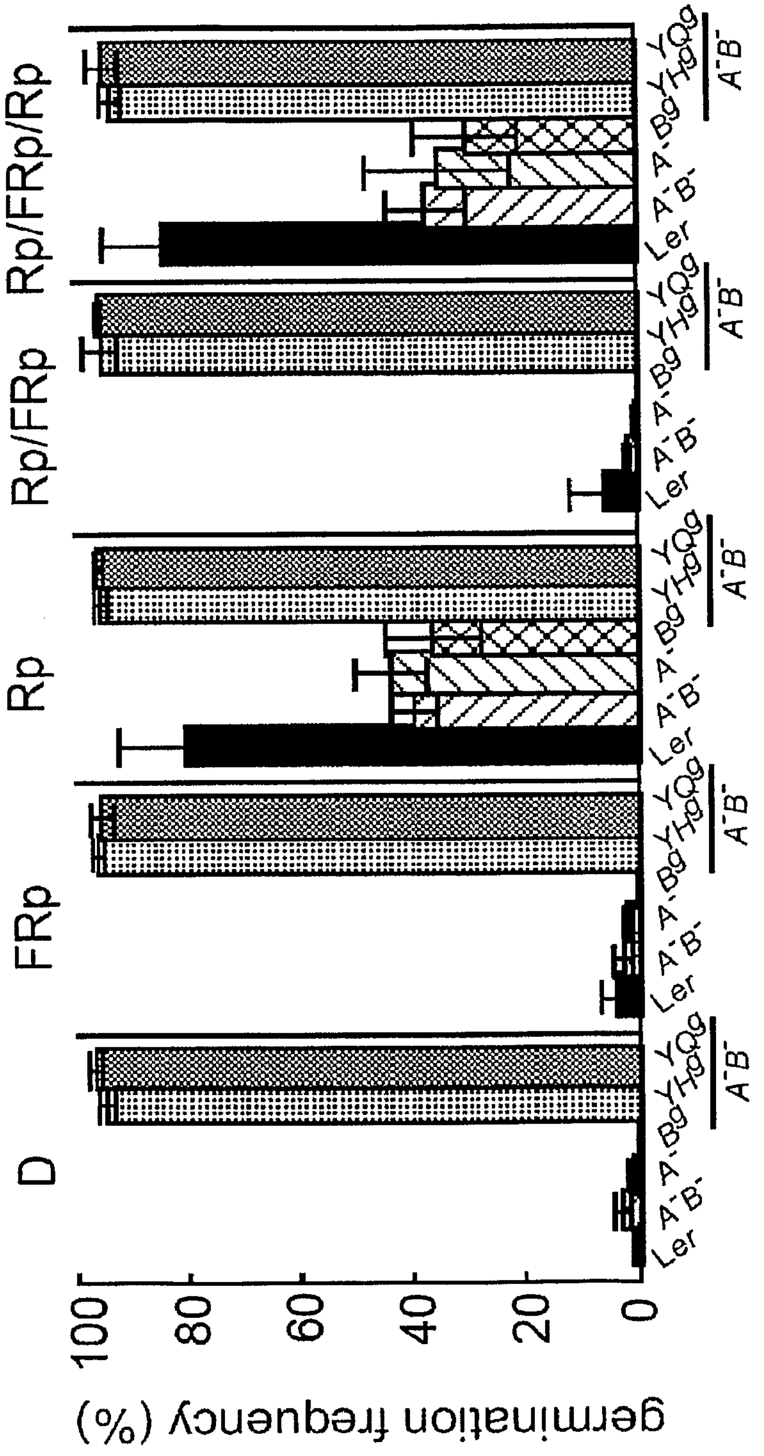
FIG. 23 shows that YHB and YQB confer a light-independent seed germination phenotype to transgenic plants. Comparative analysis of seed germination phenotypes of wild type, phyA-201 ($A^-$), phyA201/phyB-5 ($A^-B^-$), and $A^-B^-$ mutants transformed with wild-type $B^g$, $YH^g$ or $YQ^g$ genomic alleles of AtPHYB reveal light-independent promotion of seed germination by expression of the constitutively active $YH^g$ or $YQ^g$ alleles of AtPHYB. Germination was performed with cold-imbibed seeds that were pretreated with a saturating 18 mmol $m^{-2}$ pulse of far-red (FRp) at the end of imbibition. Immediately prior to incubation at 23° C., each genotype was treated with saturating 5 mmol $m^{-2}$ pulses of far-red light (FRp), 1.5 mmol $m^{-2}$ pulses red light (Rp), red light followed by far-red light (RpFRp) or red light, followed by far-red light, followed by red light (RpFRpRp). Mean germination efficiencies (+/−s.e.; n=3 or 4, ~100 seeds each) were scored six days later.

*Arabidopsis* seed germination is primarily regulated by phyA and phyB (Shinomura (1997) *J. Plant Res.* 110: 151-161). Since freshly imbibed seeds typically possess little phyA owing to its light lability, seed germination of many plant species is primarily promoted by R and inhibited by FR. *Arabidopsis* seed germination is strongly inhibited by a short pulse of far-red light (FRp) that photoconverts the Pfr form of phyB already present in the seed to its inactive Pr form (Id.). The promotive effect of a pulse of red light (Rp) on *Arabidopsis* seed germination can be strongly reversed by a subsequent FRp via the so-called low fluence response (LFR)—a response that is strongly mediated by phyB (Shinomura et al. (1998) *Plant J.* 13: 583-590; Shinomura et al. (1996) *Proc. Natl. Acad. Sci. USA* 93: 8129-8133). To test the phenotypic consequence of $Y^{GAF}$ alleles on seed germination, and to avoid the contribution of endogenous phyA and phyB to this response, we determined the light-dependency of seed germination of YHB- and YQB-expressing lines in the phytochrome-deficient phyA/phyB background (FIG. 23). These studies show that seed germination efficiency of both $Y^{GAF}$ mutant lines was nearly 100% in complete darkness and under all light regimes tested (i.e. Rp, FRp, Rp/FRp and Rp/FRp/Rp). By comparison, the frequencies of seed germination of Ler, phyA and phyA/phyB control lines were strongly stimulated by red light (Rp) and reversed by far-red (FRp) (FIG. 23). Since Ler plants express both wild-type phyA and phyB photoreceptors, its Rp dependent promotion of germination was significantly greater than those of the phyA/phyB and phyA control lines that lack functional phyA as expected. Seed germination of $B^g$ plants was also similar to the phyA/phyB and phyA control lines under all light conditions, showing that expression of the wild-type $B^g$ allele does not confer the light-independent seed germination phenotype. These studies demonstrate that the YHB or YQB mutants are constitutively active, and more significantly, that their light-independent promotion of seed germination is not inhibited by FR.

YHB Promotes Flowering of *Arabidopsis* Under Short Days.

Figure 24:
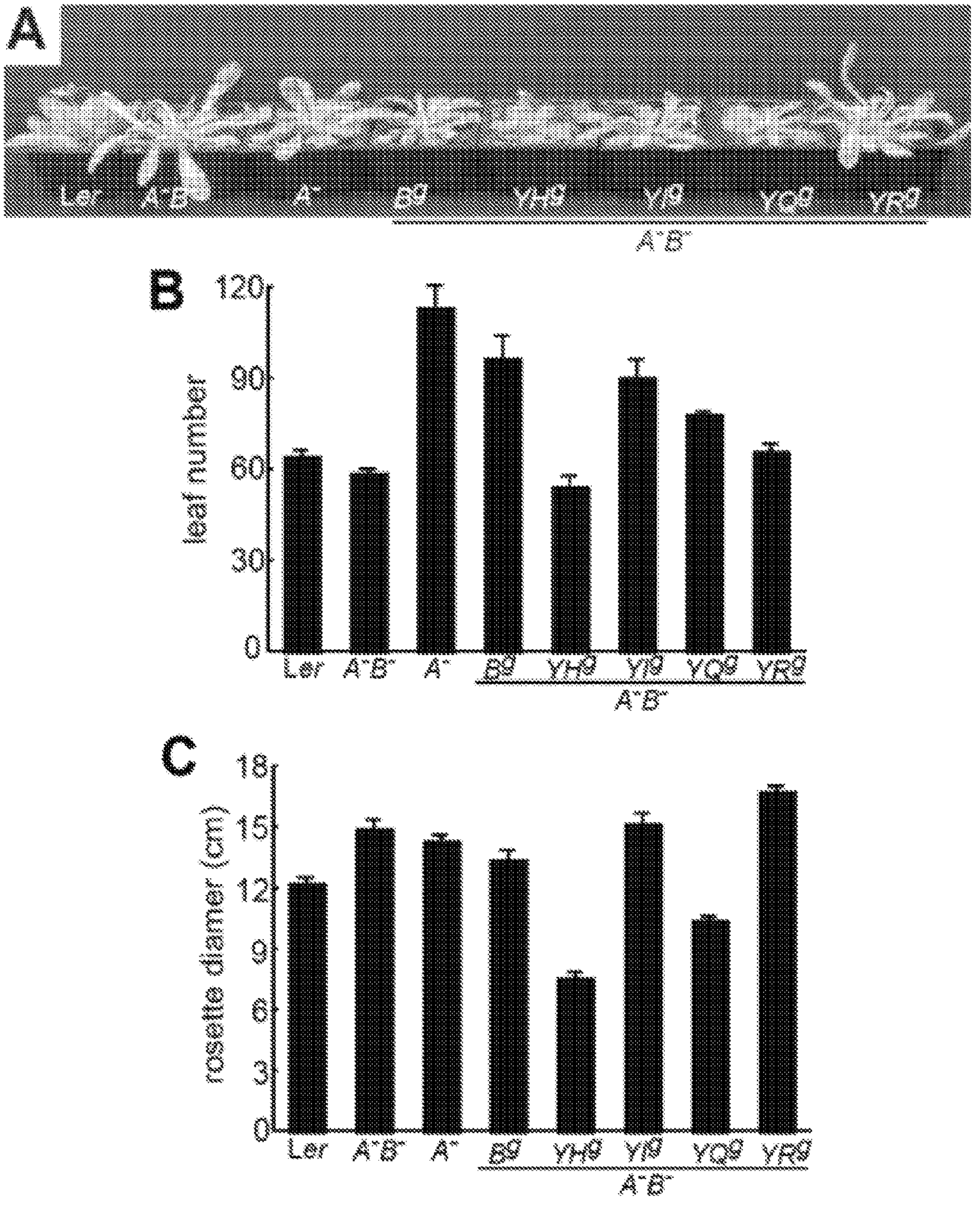
FIG. 24, panels A-C, shows flowering behavior and rosette morphology of $Y^{GAF}$ mutants under short day photoperiods. Panel A: Rosette diameters of five-week-old transgenic $A^-B^-$ plants expressing wild-type $B^g$, $YH^g$, $YI^g$, $YQ^g$ and $YR^g$ genomic alleles of AtPHYB grown under 8 h-light (100 μmol $m^{-2}$ $s^{-1}$)/16 h-dark photoperiods reveal that the wild-type $B^g$, $YH^g$ and $YQ^g$ alleles, but not $YR^g$ and $YI^g$, can (more than) rescue the elongated rosette phenotype of the $A^-B^-$ double mutant. Panel B: YHB expression slightly promotes flowering of $A^-B^-$ plants as measured by mean leaf number at bolting (+/−s.e.; n=6), while all other functional alleles of PHYB, i.e. $B^g$, $YI^g$ and $YQ^g$, delay flowering. Panel C: As measured by mean rosette diameter (+/−s.e.; n=6) at bolting, YHB- and YQB-expressing plants exhibited dwarf-like properties consistent with plants grown under long days and/or under full sunlight.

To test whether the gain-of-function phenotypes of $Y^{GAF}$ mutants affected plant architecture and flowering behavior under photoperiod growth, we compared the flowering behavior of the four $Y^{GAF}$ alleles with the wild-type $B^g$ allele in phyA/phyB backgrounds under short days (FIG. 24). Since the $Y^{GAF}$ alleles were introduced into phyA/phyB backgrounds, our comparison included the phyA/phyB parent line, the $B^g$ transformant of the parent phyA/phyB line, and the phyA background that would result if these mutants complemented the phyB deficiency of their phyA/phyB parent as controls. Under our experimental conditions, the phytochrome-deficient phyA/phyB double mutant parent flowers similarly to Ler wild-type plants under short days as judged by total leaf number at flowering, while phyA-deficient mutants exhibit a delayed flowering phenotype with significantly more leaves (FIG. 24, panel B). As expected, expression the wild-type $B^g$ allele complements the phyB deficiency of the phyA/phyB double mutant as these plants phenocopy the delayed flowering phenotype of the phyA mutants (Lin (2000) *Plant Physiol.* 123: 39-50). By comparison, the $YI^g$ and $YQ^g$ alleles partially complement the phyB-deficiency of the phyA/phyB double mutant judging by the increased leaf number, while the $YR^g$ allele fails to complement the phyB-deficiency. Interestingly, $YH^g$ transformants in the phyA/phyB background exhibit an early flowering phenotype under short days, flowering with significantly fewer leaves than the phyA-deficient mutant. This result starkly contrasts with complementation of the phyA/phyB parent with the wild-type $B^g$ allele that affords transformants that flower similarly to the phyA mutant. Early flowering behavior under short day photoperiods would be consistent with light-independent signaling by YHB—an effect that 'phenocopies' the accelerated flowering response of *Arabidopsis* to long days. However, more detailed experiments are needed to adequately assess this hypothesis.

In addition to the leaf number phenotype, the rosette diameters of short day-grown plants expressing YHB mutants were significantly smaller than those of Ler, phyA and phyA/phyB plants complemented with the wild-type $B^g$ allele (FIG. 24, panel C). A similar effect on rosette diameter was seen for plants expressing the YQB mutant, while rosette diameter of the YIB and YRB mutant plants were similar to the untransformed parent line. The reduced rosette size of YHB and YQH plants is consistent with development under high R/FR ratios—conditions that favor the activation of phyB and the suppression of shade avoidance responses (Nagatani et al. (1991) *Plant Cell Physiol.* 32: 1119-1122). Taken together, these studies support the interpretation that light-independent $YH^g$ signaling activity supersedes phyB-mediated perception of both short days and light quality. We therefore predict that YHB plants will be photoperiod-insensitive, a conclusion that necessitates further investigation.

The $Y^{GAF}$H Allele of PHYA Exhibits Gain-of-Function Activity in Darkness and Acts as a Dominant-Negative Mutant Under Continuous Far Red Light.

Figure 25:
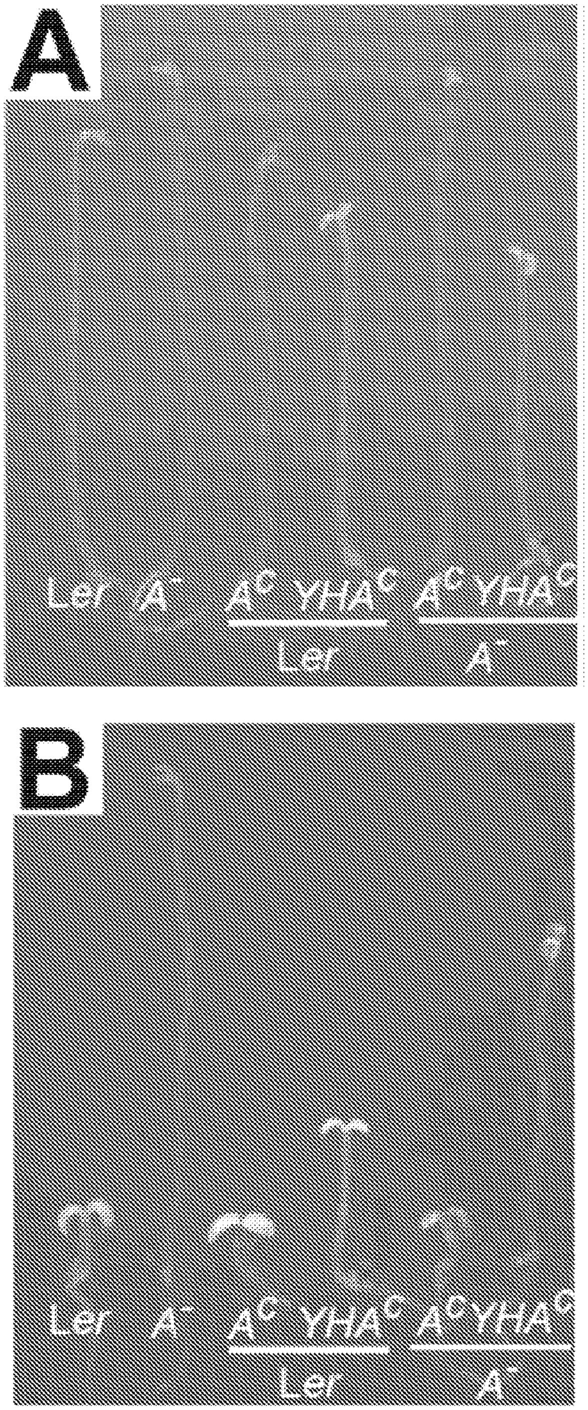
FIG. 25, panels A-D, shows gain-of-function activity of the $Y^{GAF}$H mutant of phytochrome A (YHA). Panel A: Comparative morphogenesis of six-day-old dark-grown seedlings reveals that transgenic plants expressing the $Y^{GAF}$ HcDNA allele of AtPHYA ($YHA^c$) exhibit a weak COP phenotype not observed for Ler wild type or transgenic plants expressing wild-type AtPHYA ($A^c$) cDNA alleles. Panel B: Comparative morphogenesis of six-day-old seedlings grown under 20 μmole $m^{-2}$ $sec^{-1}$ FRc indicates $YHA^c$ is a gain-of-function dominant-negative allele (in Ler background) and partially complements the phyA-deficiency in phyA-201 background. Panel C: Immunoblot analysis of PHYA protein levels was performed as in FIG. 16 using monoclonal anti-PHYA O73D as the primary antibody. Panel D: Comparative fluence response curves for hypocotyl growth indicate that YHA possesses gain-of-function FRc-independent signaling activity in phyA-deficient phyA-201 background and interferes with the FR HIR response of endogenous phyA in Ler background. Each data point represents the mean of 50 seedlings +/−s.d.
Figure 30:
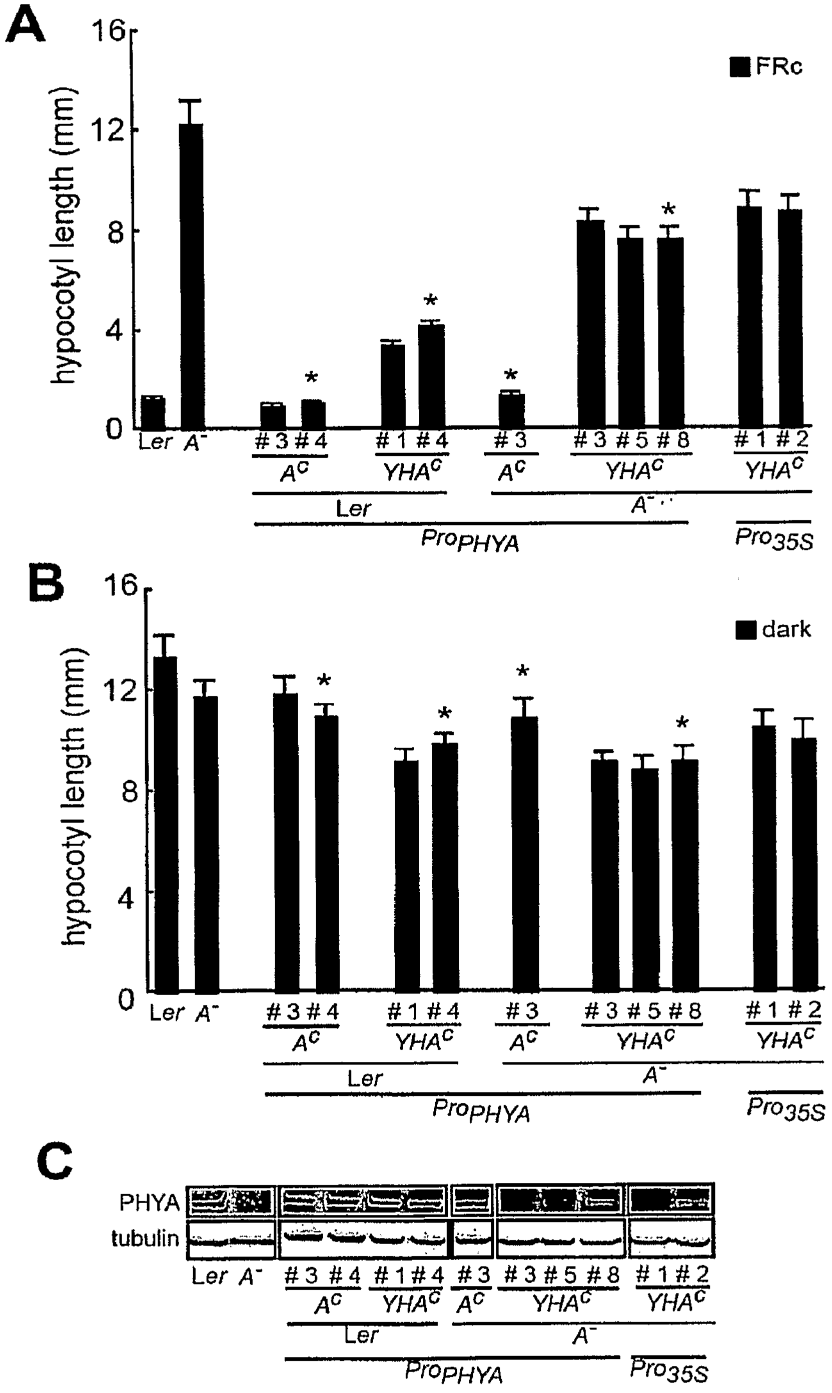
FIG. 30, panels A-C, shows comparative hypocotyl length measurements and immunoblot analysis of multiple transgenic lines expressing $Y^{GAF}$H mutant of phytochrome A in different genetic backgrounds grown under continuous far-red or darkness. Panel A: Mean hypocotyl length (+/−s.d.; n=50) of six-day-old wild type and Y242H-PHYA ($YHA^c$) transgenic seedlings grown under continuous far-red light (FRc) at a fluence rate of 20 μmol $m^{-2}$ $sec^{-1}$. Asterisks indicate the representative lines shown in FIG. 25. Abbreviations: $A^-$: phyA201, Ac: wild-type PHYA cDNA, YHAc: Y242H-PHYA cDNA, ProPHYA: *Arabidopsis* PHYA promoter, Pro35S: 35S promoter. Panel B: Mean hypocotyl length (+/−s.d.; n=50) of six-day-old wild-type PHYB- and YHA-expressing seedlings grown in complete darkness. Panel C: PHYA protein levels in six-day-old dark-grown transgenic seedlings (40 g total protein per lane) were determined using polyclonal anti-PHYA as the primary antibody. Genotype and transgene abbreviations are as in FIGS. 27 and 28.

To evaluate the biological activity of the $Y^{GAF}$H mutant of AtPHYA (i.e. Y242H for AtPHYA), wild-type $A^c$ and $YHA^c$ mutant cDNA alleles of PHYA under the control of the AtPHYA promoter were introduced into Ler wild type and phyA-201 ($A^-$) null mutant backgrounds (FIG. 1 and Table 2). Hypocotyl lengths of dark- and FRc-grown seedlings of homozygous lines were then measured (FIG. 25 and FIG. 30, panels A-B). As expected (Smith (1994) *Sem. Cell Biol.* 5: 315-325), expression of the wild-type $A^c$ allele did not significantly affect skotomorphogenesis of Ler wild type or $A^c$-complemented phyA seedlings (FIG. 25, panel A), and the $A^c$-transformant in the Ler background was hypersensitive to FRc compared with Ler reflecting the excess accumulation of phyA (FIG. 25, panels B-C). By contrast, $YHA^c$-expression both in Ler wild type and phyA backgrounds yielded dark-grown seedlings with open cotyledons and slightly shorter hypocotyls—a phenotype similar to, but not as striking as YHB-expressing transformants (FIG. 25, panel A). Under FRc however, $YHA^c$-expressing seedlings in Ler background developed significantly longer hypocotyls compared with seedlings possessing only wild-type PHYA alleles (FIG. 25, panel B; compare $YHA^c$/Ler with Ler, $A^c$/Ler and $A^cA^-$).

These results indicate that, at this fluence rate of FRc, the $YHA^c$ allele encodes a dominant-negative protein that attenuates the signaling output activity of wild-type PHYA.

To more fully examine the photoregulatory activity of YHA, fluence rate response measurements for hypocotyl growth inhibition were performed (FIG. 25, panel D). These studies showed that the activity of the YHA mutant is independent of the FRc fluence rate—in striking contrast with the strong fluence rate dependency of seedlings possessing only wild-type PHYA alleles (FIG. 25, panel D; compare $YHA^c/A^-$ with Ler, $A^-$/Ler and $A^c/A^-$). Indeed, the wild-type $A^c$ allele fully complemented the FRc-dependent inhibition of hypocotyl elongation of the phyA mutant, restoring the fluence rate response to that of Ler wild type at fluence rates of FRc above 2 μmol $m^{-2}$ $s^{-1}$ (FIG. 25, panel D). Interestingly, the light-independent gain-of-function activity of YHA in wild-type Ler backgrounds in darkness was balanced by a light-dependent dominant-negative activity at higher fluence rates. At low fluence rates of FRc, YHA seedlings in the Ler background have shorter hypocotyls than Ler wild type (as observed in darkness), while at high fluence rates, YHA seedlings have longer hypocotyls (FIG. 25, panel D; compare Ler with YHA'/Ler). This result shows that $YHA^c$ functions as a constitutive gain-of-function allele in darkness and a dominant-negative allele under elevated fluence rates of FRc.

The gain-of-function activities of YHA are even more significant if one accounts for the relative accumulation of wild-type PHYA and YHA mutant proteins especially in the phyA backgrounds (FIG. 25, panel C). This indicates that the constitutive photomorphogenetic activity of YHA is not due to greater expression of the YHA mutant protein. However, the dominant-negative activity of YHA at elevated fluence rates of FRc may be dependent on the level of YHA expression, but additional work is needed to resolve this possibility. Based on these results, we conclude that $Y^{GAF}H$ mutants of both PHYA and PHYB are dominant, gain-of-function alleles that confer light-independent constitutive signaling activity to their corresponding holoproteins.

Discussion

The phytochrome family is the most extensively studied of the light-activated regulators of photomorphogenesis in plants (Schäfer and Nagy (2005) *Photomorphogenesis in Plants and Bacteria: Function and Signal Transduction Mechanisms* (3rd Edition). (Dordrecht, The Netherlands: Springer)). Despite extensive photobiological, genetic and molecular analysis on phytochrome since its identification nearly 50 years ago (Sage (1992) *Pigment of the Imagination: A History of Phytochrome Research*. (San Diego: Academic Press, Inc.)), the primary molecular mechanism of phytochrome signaling remains obscure to this day. In this regard, the identification of constitutively active $Y^{GAF}$ alleles of phytochromes represents a significant breakthrough for a number of reasons. First, their constitutive signaling activities imply that $Y^{GAF}$ mutant photoreceptors adopt stable, 'signaling-on' conformations. This will facilitate biochemical and biophysical analyses of 'photoactivated' forms of phytochromes that are not experimentally practicable with wild-type phytochrome preparations. Second, the intense red fluorescence of YH mutants allows investigation of phytochrome dynamics at the single molecule level without the need for appending a fluorescent protein tag (Miller et al. (2006) *Proc. Natl. Acad. Sci. USA* 103: 11136-11141). Combined with the observation that bilin is required for YHB activation, it is now possible to monitor the 'light-initiated' processes of nuclear migration and nuclear-body formation of phytochromes in real time by fluorescence microscopy following addition of exogenous bilin to chromophore-deficient YHB-expressing plants. Third, bilin-mediated activation of the YHB mutant also facilitates experiments to study phyB-specific signaling without activation of other phytochromes and/or other photoreceptors by light. Indeed, this approach ultimately can be exploited to probe signaling networks specific to each member of the phytochrome family. Finally, constitutively active alleles of phytochromes represent a powerful new tool for genetic engineering of agronomically important plant species. Our studies indicate that the YH allele of PHYB holds great promise for suppressing shade avoidance growth responses, promoting seed germination and influencing flowering behavior of *Arabidopsis thaliana* in the natural environment, implicating a wide variety of applications for tailoring the light responsiveness of crop plant species.

$Y^{GAF}H$ Mutants of phyB are More Active than Wild-Type phyB and $Y^{GAF}H$ Mutants of phyA.

The observation that plants expressing $Y^{GAF}H$ mutants of both PHYA and PHYB exhibit constitutive photomorphogenetic development in darkness establishes that the functional consequence of this mutation is the light-independent activation of both photoreceptors. While the extent of the gain-of-function activities is difficult to quantify from our data, the signal output appears greater for YHB compared with that of YHA. In this regard, hypocotyl growth inhibition and cotyledon expansion of dark grown seedlings appeared fully activated in YHB transformants while YHA seedlings only showed partial activation of these 'photomorphogenetic' responses in darkness. We interpret the observed gain-of-function activities of both YHA and YHB as reflecting the same structural consequence, i.e. that the $Y^{GAF}H$ mutation confers a conformation that mimics the photoactivated Pfr form for both phytochromes. Indeed, our studies have shown that the constitutive activity of YHB correlates with its nuclear localization and the ability to up-regulate the expression of light-inducible genes in darkness—phenotypes fully consistent with light-independent activation of phytochrome signaling.

The effect of the $Y^{GAF}H$ mutation is most dramatic for the phyB photoreceptor, and fluence rate response curves indicate that the regulatory output activity of the YHB mutant is light-independent, exceeding that of fully light-activated wild-type phyB (see FIG. 21, panel C). At a fluence rate of 20 μmol $m^{-2}$ $s^{-1}$ Rc, hypocotyl growth suppression of $YHB^g$/phyA/phyB plants is more pronounced than that of $B^g$/phyA/phyB plants which accumulate similar amounts of PHYB protein (see FIG. 18, panel D or FIG. 20, panel C; compare PHYB protein in $YHB^g$/phyAphyB and $B^g$/phyA/phyB lines). The enhanced hypocotyl growth response of $B^g$/phyA/phyB plants compared with Ler at 20 μmol $m^{-2}$ $s^{-1}$ Rc may reflect a slightly increased level of PHYB protein in the former (see blots in FIG. 18, panel D or FIG. 20, panel C). This apparent response enhancement might also be due to the lack of functional phyA in $B^g$phyA/phyB plants, since phyA is known to antagonize the signaling activity of phyB (Smith (1994) *Sem. Cell Biol.* 5: 315-325). The enhanced regulatory activity of the YHB mutant was also observed for seed germination of the $YHB^g$/phyA/phyB line—the frequency of which exceeded those of all other genotypes under all light conditions examined (see FIG. 23).

We attribute the light-independent hyperactivity of YHB in part to the inability of Rc to fully photoconvert wild-type phyB to 100% Pfr. Owing to the absorption overlap of Pr and Pfr forms, Rc can only produce a maximum of ~85% Pfr—a result that has only been rigorously determined for phyA (Lagarias et al. (1987) *Photochem. Photobiol.* 46: 5-13). In view of its pronounced dark reversion, this percent photoconversion may be even lower for phyB, especially under lower fluence rates of light (Hennig and Schäfer (2001) *J. Biol. Chem.* 276: 7913-7918). Based on this reasoning, one might expect that the YHB mutant would be more active than wild-type phyB, since its activation is light independent and would therefore not be constrained to the photoequilibrium limitation of wild type. The lack of dark reversion would also contribute to the sustained activity of the YHB mutant in both darkness and under low fluence rates of light. Thus, the observed suppression of shade avoidance and the early flowering phenotypes would reflect a fully stable pool of active YHB phytochrome.

Our studies show that YHA is not as active as YHB in darkness, nor can its activity be increased by illumination with far-red light in phyA genetic backgrounds (FIG. 25, panel D). YHA thus appears locked into an active conformation, although apparently one that is less active than YHB and one that is less active than fully light-activated wild-type phyA. The partial activity of YHA can be attributed to the different modes of action of phyA and phyB photoreceptors (Reed et al. (1994) *Plant Physiol.* 104: 1139-1149; Furuya and Schäfer (1996) *Tr. Plant Sci.* 1: 301-307). Owing to its light lability and negative feedback of its own transcription, phyA accumulation in plants is strongly light regulated (Quail (1991) *Ann. Rev. Genet.* 25: 389-409). This light-lability is responsible for the low abundance of phyA in light-grown plants and its elevated level in dark-grown plants. Thus, light-independent activation might be expected to alter YHA's stability thereby reducing its signaling output. Based on an elegant two pulse experimental setup, Shinomura et al proposed that the active form of phyA that mediates the FRc high irradiance response (FRc HIR) is not Pfr, but a Pr species that had been cycled through Pfr (Shinomura et al. (1996) *Proc. Natl. Acad. Sci. USA* 93: 8129-8133). The reduced activity of YHA under high fluence rates of FRc may therefore reflect the fact that YHA is locked into a Pfr-like state that is not as active as cycled Pr.

The dominant-negative phenotype of YHA-expressing transgenic plants in wild-type Ler backgrounds is consistent with both scenarios. Since phyA is an obligate homodimer, we envisage that the reduced activity of the YHA protein is responsible for inhibiting the signaling output of wild-type phyA through the formation of heterodimers in the Ler background. The partial constitutive activity of YHA is responsible for the unusual fluence rate response of YHA/Ler plants which exhibit an 'apparent' enhanced response to low fluence rates of FRc, and a reduced response to elevated FRc (see FIG. 25, panel D). We thus attribute this reduced FRc high irradiance response (FRc HIR) to the formation of YHA: PHYA heterodimers whose stability, activity and/or light-dependent activity are lower than those of wild-type PHYA homodimers. In view of the chromophore-dependence of the YHB phenotype, it is also possible that the reduced activity of YHA may in part reflect a lower rate and/or amount of chromophore assembly by comparison with the wild-type PHYA apoprotein. Taken together, we believe that the inherent differences in the stabilities and molecular mechanisms of the phyA and phyB photoreceptors are responsible for the quantitative differences in the gain-of-function activities of the YHA and YHB mutants.

The Biological Activities of Other $Y^{GAF}$ Mutants of phyB Implicate a Critical Role of the GAF-Domain Tyrosine Residue in Light Signaling.

Our studies show that the phenotypic consequence of the mutation of the $Y^{GAF}$ residue of phytochrome B is strongly dependent on the particular amino acid substitution chosen. H and Q substitutions both confer gain-of-function COP activity in darkness, suggesting that the two amino acid substitutions have similar effects on structural and biological properties of phyB. In contrast with the light-independent constitutive activity of YHB, YQB retains some light sensitivity towards Rc (FIG. 21, panel C) and also a small response to increasing fluence rates of FRc (FIG. 22, panel C). It is interesting that both $Y^{GAF}$H and $Y^{GAF}$Q substitutions have similar effects on the spectroscopic properties of Cph1, i.e. the two mutants are strongly fluorescent and both possess extended, protonated bilin chromophores (Fischer et al. (2005) *Biochem. ACS* 44: 15203-15215). This suggests that the structural perturbation in the chromophore-binding pocket that gives rise to the fluorescence gain-of-function of these $Y^{GAF}$ mutants mirrors the light-activation of phytochrome. However, the ability of YQB to respond to light suggests that the residual photochemistry of this mutant, while reduced, is capable of generating sufficient Pfr to transduce a measurable light signal that is additive with its light-independent constitutive activity. Since YQB is an allele of PHYB, we presently cannot readily explain the small response of the YQB mutant to high irradiances of FRc (FIG. 22, panel C). Such a FRc-dependent response could be due to a gain-of-function neomorphic phyA-like activity of the YQB mutant itself. Since phyB has been shown to form heterodimers with phyC-E in *Arabidopsis* (Sharrock and Clack (2004) *Proc. Natl. Acad. Sci. USA* 101: 11500-11505), we cannot dismiss the possibility that this effect reflects a novel FRc-dependent activity of the heterodimer of YQB with another light-stable phytochrome.

The correlation of biological activity with the spectral property of the specific $Y^{GAF}$ mutation is further underscored by the phenotypic consequences of the expression of YIB and YRB mutants—neither of which confers a COP-like phenotype to transgenic plants. Our studies clearly show that $YIB^g$ complements the phyB-deficiency of the phyA/phyB background under We while $YRB^g$ does not (FIG. 20, panel D). With regard to Rc-mediated hypocotyl growth inhibition, $YIB^g$/phyA/phyB transgenic plants are similar to phyA/phyB plants complemented with the wild-type $B^g$ allele (FIG. 20, panel A-B, FIG. 21, panel C). Our studies show that both lines show strong Rc-dependent inhibition of hypocotyl growth inhibition, although the YIB mutant appears slightly less active than wild-type PHYB. By contrast, the YIB mutant appears considerably less active than the wild-type photoreceptor under light/dark cycles (FIG. 21, panel D). These results show that the YIB is photobiologically active, and also suggest that the light-activated Pfr form of this mutant is unstable, presumably reverting to the inactive Pr form in darkness. These observations are particularly interesting in view of the spectroscopic properties of the corresponding $Y^{GAF}$I mutant of Cph1 (Fischer et al. (2005) *Biochem. ACS* 44: 15203-15215). This poorly photoactive Cph1 mutant possesses a more cyclic, porphyrin-like chromophore with a strongly blue-shifted absorption maximum. Our results suggest either that the YIB mutant is more fully photoactive than the YI mutant of Cph1, or that the specific activity of the light-activated Pfr form of YIB mutant is greater than that of wild-type phyB. By contrast with YHB, YQB and YIB, the YRB mutant appears fully inactive judging by the lack of complementation of the phyB-deficient phyA/phyB background under Wc or Rc (FIGS. 20-22). This loss-of-function activity was not unexpected, since the $Y^{GAF}$R mutant of Cph1 exhibited altered chromophore-binding specificity with a pronounced affinity for porphyrins (Fischer et al. (2005) *Biochem. ACS* 44: 15203-15215). However, we have not yet assessed whether this loss-of-function is due to loss of chromophore binding, alternative chromophore binding or loss of photochemistry. While we presently cannot resolve the reasons for the distinct regulatory activities of the various $Y^{GAF}$ mutants until measurements of protein levels, chromophore binding and spectroscopic properties of the phytochrome proteins produced in planta are more rigorously assessed, these studies underscore the importance of the conserved GAF domain tyrosine to the signaling activity of plant phytochromes.

Mechanistic Implications of $Y^{GAF}$ Mutant Studies—An Emerging Model for Phytochrome Signaling.

The constitutive signaling activity of select $Y^{GAF}$ mutants of plant phytochromes indicates that these receptors must bypass two light-dependent processes. Light activation not only induces translocation of phytochromes into the nucleus (Nagatani (2004) *Curr. Opin. Plant Biol.* 7: 708-711), but sustained light activation is required for their interaction with, and regulation of, nuclear factors that modulate gene transcription (Khanna et al. (2004) *Plant Cell* 16: 3033-3044). Based on functional analysis of deletion mutants of AtphyB in transgenic plants, a molecular mechanism for phytochrome signaling has emerged in which the signaling activity of the N-terminal photosensory domain (PSD) of phytochrome is repressed by interaction with regulatory domains within the C-terminus. In support of this hypothesis, Nagatani and colleagues report that a severely truncated PSD is sufficient for full phyB signaling (Matsushita et al. (2003) *Nature* 424: 571-574). However, their studies also reveal that this activity requires a nuclear localization signal (NLS) and a protein dimerization motif—both of which were removed by the truncation. Based on these results and the discovery that the C-terminus of phyB harbors a cryptic NLS, Chen et al suggest that the initial process following light-activation is the exposure of the NLS that triggers phyB translocation into the nucleus (Chen et al. (2005) *Curr. Biol.* 15: 637-642). Within the nucleus, phytochrome must be maintained in the Pfr form for full and sustained regulatory activity—a property that is correlated with the amount and size of nuclear bodies (speckles) (Id). Taken together, these results support the hypothesis that the PSD is held in a repressed state by its interaction with C-terminal regulatory domains (CTRDs) both within the cytosol and within the nucleus.

Figure 26:
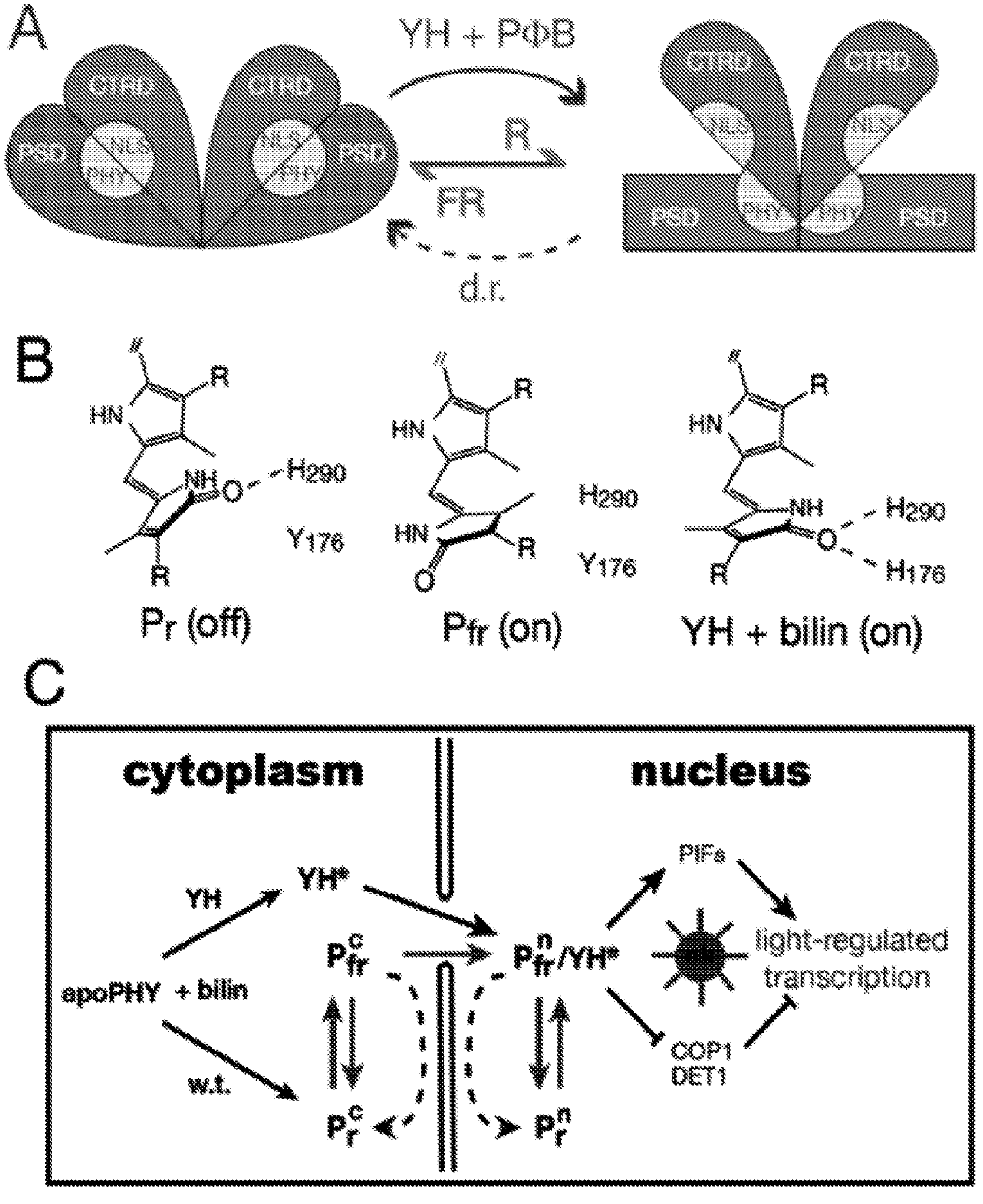
FIG. 26, panels A-C, shows a proposed mechanism of light-independent light signaling by YH mutant phytochromes. Panel A: A proposed scheme of phytochrome protein conformational changes is shown. In wild type (w.t.) and YH mutant apoproteins and the Pr form of wild type (left), the Photosensory Domains (PSD) are tightly associated with the C-Terminal Regulatory Domains (CTRD). This association masks a cryptic NLS located in the PAS repeat region within the CTRD that is specific to plant phytochromes (Chen et al. (2005) *Curr. Biol.* 15: 637-642). Activation occurs by Pr to Pfr photoconversion for wild type, or by assembly with phytochromobilin (PB) for YH to produce the activated species YH*. This results in release (or uncoupling) of the CTRD domain from the PSD by chromophore-mediated allosteric changes within the GAF domain that potentially are transduced via the PHY subdomain of the PSD. We envisage that this conversion exposes the CTRDlocalized NLS, triggering nuclear translocation of phytochrome. For wild type, this conversion is metastable and can be reversed both by FR irradiation or by dark reversion (d.r.). Panel B: Proposed interactions of the bilin chromophore D ring with GAF domain residues $Tyr_{176}$ and $His_{290}$, using the numbering of the DrBphP bacteriophytochrome (Wagner et al. (2005) *Nature* 438: 325-331), are shown for wild-type phytochrome in Pr (left) and Pfr (center) states and for chromophore-bound YH phytochrome (right). Based on homology modeling to DrBphP, the carbonyl oxygen (O19) of the photoisomerizing D-ring of plant phytochromes is predicted to be H-bonded to $His_{290}$ in the Pr form, while Tyr176 is close but not in direct contact with the chromophore (Rockwell et al. (2006) *Ann. Rev. Plant Biol.* 57: 837-858). We envisage that photoisomerization of the C15 double bond disrupts this H-bond leading to new chromophore-protein and protein-protein interactions that trigger the uncoupling of the PSD and CTRD depicted in panel A. In the YH mutant, we propose that chromophore binding generates a new H-bonding interaction with the D-ring carbonyl—an interaction that also uncouples the PSD and CTRD. This 'histidine-trap' model is consistent with the enhanced fluorescence of YH mutants as it would potentially stabilize the Pr excited state to permit fluorescence emission. Panel C: A cellular model for phytochrome signaling. For wild type (w.t.) phytochromes, nuclear migration, nuclear body (speckle) formation and transcription of light-regulated genes require both P~B chromophore binding (arrows on left) and red light activation. While the relationship of nuclear body (nb) formation to PIF-dependent transcription, proteosome-mediated protein turnover of these factors and COP1- and DET1-dependent repression pathways remains unresolved, all of these phyB-mediated signaling processes are reversed by far red light and/or by dark reversion (dashed arrows). By contrast, PΦB binding is sufficient for light-independent activation of the YH mutant of phytochrome B since YH* activates these processes in the absence of light (solid arrows). Phytochromobilin (PΦB); superscript "c" and "n" refer to cytoplasmic and nuclear localization, respectively.

Using fluorescence microscopy, our studies establish that nuclear localization and speckle formation of the $Y^{GAF}$H mutant of phytochrome B are constitutive—a result fully consistent with the light-independent disruption of the intra-domain interactions that inhibit both of these signal transfer steps. Our investigations also show that chromophore binding is required for full de-repression since the gain-of-function activity of YHB is strongly suppressed in the chromophore-deficient hy1 background. We therefore conclude that the gain-of-function activity of YHB reflects a chromophore-induced protein conformational change of the YHB apoprotein that mimics light activation of the wild-type photoreceptor. Similar to a recent proposal (Id.), we envisage a model for phytochrome signaling in which activation involves a chromophore-dependent perturbation of residues within the GAF domain of the PSD that releases its interaction with the CTRD—a process that is light-requiring for wild-type phytochrome, but chromophore-mediated and light-independent for YHB (FIG. 26, panel A).

This hypothesis is consistent with limited proteolytic studies on phyA preparations that indicate that the C-terminus is more readily cleaved upon photoconversion to Pfr (Lagarias and Mercurio (1985) *J. Biol. Chem.* 260: 2415-2423). By comparison with wild-type Cph1, limited proteolysis of the $Y^{GAF}$H mutant of Cph1 indicates that the latter is considerably more susceptible to limited proteolysis (unpublished data). While a detailed comparison between wild-type and $Y^{GAF}$H mutants is required for a more definitive assessment of this hypothesis, these preliminary studies support the interpretation that chromophore-signaling by $Y^{GAF}$H mutants and light signaling by wild-type reflect the same overall process, i.e. the release of PSD-CTRD interactions that restrain the signaling output of one/or both domains.

In spite of identical signaling outputs, we expect that the molecular mechanism underlying signal activation of wild type and $Y^{GAF}$H mutants will not be the same. Homology models of the chromophore binding sites of Cph1 and plant phytochromes based upon the published crystal structure of the biliverdin-binding domain of the bacteriophytochrome DrBphP (Wagner et al. (2005) *Nature* 438: 325-331) and analysis of homology to DrBphP indicate that the $Y^{GAF}$ residue lies near the bilin prosthetic group (Rockwell and Lagarias (2006) *Plant Cell* 18: 4-14; Rockwell et al. (2006) *Ann. Rev. Plant Biol.* 57: 837-858). Preliminary molecular dynamic simulations indicate that the $Y^{GAF}$H histidine sidechain can adopt an alternative orientation that potentially could form an H-bond with the bilin chromophore (unpublished results). In addition to accounting for the enhanced fluorescence of the $Y^{GAF}$H mutant, this gain-of-function interaction would necessarily come at the loss of molecular interactions of the wild-type $Y^{GAF}$ sidechain that stabilize the 'repressed' signaling-inactive conformation. We thus propose that such 'uncoupling' of the normal $Y^{GAF}$-apoprotein interactions occurs by its replacement with histidine (or glutamine) and that this constitutive 'uncoupling' is the reason for the gain-of-function activity of the YHB mutant (FIG. 26, panel B).

Is it possible that the normal light-dependent derepression of PSD function in wild-type phytochromes might be mediated by an analogous, albeit distinct, chromophore-dependent 'uncoupling' of $Y^{GAF}$-apoprotein interactions? Owing to Pfr dark reversion, full activity of wild-type phyB necessitates elevated fluence rates of Rc to sustain the optimum steady state level of Pfr (Chen et al. (2003) *Proc. Natl. Acad. Sci. USA* 100: 14493-14498). This implies that the light-dependent uncoupling process is meta-stable in the wild type—a result that contrasts with the apparent thermal stability of the activated form of YHB. Moreover, the poor photoconvertibility of the YHB mutant also accounts for its light-independent activity: YHB is neither activated, nor repressed by light. This is not the case for the YQB and YIB mutants, both of which show strong fluence rate-dependent hypocotyl growth inhibition responses under Rc (FIG. 21, panel C). Continuous photoactivation thus appears necessary to sustain the activated state of both mutants. Moreover, $Y^{GAF}$Q and $Y^{GAF}$I mutants of Cph1 are poorly photoactive and yield low steady state levels of a far-red absorbing species under Rc (Fischer et al (2005) *Biochem. ACS* 44: 15203-15215). We therefore interpret our results to indicate that Rc is necessary to cycle both mutants into meta-stable 'activated' species distinct from that of the wild-type Pfr form. While much work remains to fully characterize the molecular basis of the mutant phenotypes of $Y^{GAF}$ alleles of plant phytochrome, we conclude that the GAF domain tyrosine residue plays a critical role in maintaining the structure, photochemistry and signaling output of plant phytochromes.

Finally, the present studies show that two representative light-regulated genes are activated in YHB mutants grown in darkness. Preliminary DNA microarray analyses of dark-grown YHB plants reveal that genes associated with the photomorphogenetic program of development are uniformly activated in these plants (unpublished data). Of the two characteristic genes studies here, CHS expression is notable since this its expression is normally blue/UV-light dependent in

*Arabidopsis* (Batschauer et al. (1996) *Plant J.* 9: 63-69), while CAB expression is known to be strongly phytochrome-dependent (Chory et al. (1993) pp. 57-62 In: *Cellular Communication in Plants*, R. M. Amasino, ed (New York: Plenum Press)). However, our RT-PCR studies were performed using seedlings grown on sucrose-containing media and sucrose is known to greatly enhance the expression of CHS (Tsukaya et al. (1991) *Plant Physiol.* 97: 1414-1421). The observed light-independent expression of light-regulated genes indicates that YHB must constitutively interact with the nuclear factors that mediate their transcription. Among these include members of the PIF3 family of bHLH transcription factors Bailey et al. (2003) *Plant Cell* 15, 2497-2502), components of COP1 and DET1-containing complexes that target the degradation of the bZIP transcription factor HY5 (Yi and Deng (2005) *Tr. Cell Biol.* 15: 618-625) and additional factors that participate in nuclear body formation (Chen et al. (2003) *Proc. Natl. Acad. Sci. USA* 100: 14493-14498). FIG. 26, panel C depicts the chromophore-dependent, light-independent signaling processes that we propose to be constitutively activated for the YHB mutant (in black) as well as the light-dependent processes that are regulated by wild-type phytochromes (in green and red).

Agronomic Applications of $Y^{GAF}$ Mutants to Regulate Light Responses of Crop Plant Species.

Identification of a constitutively active allele of plant phytochromes not only represents a powerful new tool to elucidate the molecular mechanism of phytochrome signaling, but also offers great potential for a number of biotechnological applications. Since the phenotypic consequence of $Y^{GAF}$H mutant expression is independent of the presence of wild-type phytochrome alleles, YHB expression potentially could prove useful as a selection marker for plant transformation. Our studies show that YHB strongly suppresses the FR-dependent inhibition of seed germination in addition to conferring a COP phenotype to dark-grown seedlings. T1 transformants expressing the YHB transgene could in principle be selected by germination following a brief pulse of FR and by their detiolated seedling phenotypes. This dual phenotypic screen should easily identify transformants—without the need for an antibiotic or herbicide.

YHB alleles also offer great potential for inhibiting shade avoidance responses. In this regard, we predict that the constitutive activity of YHB will counteract the enhanced elongation growth response of plants to FR-enriched shade- and reflected-light environments. In wild-type plants, this response primarily corresponds to the reduced steady state level of the Pfr form of the light stable phytochromes phyB-E (Franklin and Whitelam (2005) *Ann. Bot.* (*Lond*) 96: 169-175). Since such a Pfr-deficiency is overcome by YHB expression, the failure of YHB-expressing plants to respond to low R/FR ratios should lead them to develop as if they were grown in full spectrum white light. Indeed, we have shown that the growth of YHB plants is insensitive to R or FR, indicating that shade-grown YHB plants will develop most of the phenotypic hallmarks of full sunlight grown plants, i.e. reduced internode/petiole elongation, smaller rosette diameters and more prostrate leaves. Experiments to test the efficacy of YHB expression to suppress shade avoidance in rice are presently underway. We hypothesize that YHB will mitigate yield losses from shade avoidance responses only at high densities.

The present studies suggest that YHB may strongly inhibit flowering of rice. *Arabidopsis thaliana* is a facultative long day plant (Koornneef et al. (1998) *Plant J.* 22: 177-186), while most rice cultivars are short day plants (Izawa et al. (2000) *Plant J.* 22: 391-399; Yano et al. (2001) *Plant Physiol.* 127: 1425-1429). The present studies show that YHB expression promotes flowering of phytochrome-deficient phyA/phyB *Arabidopsis* plants grown under short days—conditions that significantly inhibit flowering of phyA-deficient plants harboring a wild-type phyB allele (FIG. 24, panel B). We attribute this result to the constitutive activity of YHB throughout the long night period in contrast to the loss of the promotive effect of wild-type phyB Pfr during this period due to dark reversion. YHB plants also flower slightly earlier than wild-type plants, suggesting that its constitutive activation also interferes with the circadian clock regulatory control of flowering (Yanovsky and Kay (2003) *Nature Rev. Mol. Cell. Biol.* 4: 265-275). For short day plants such as rice, we anticipate that YHB expression might inhibit flowering even under inductive short day periods—the opposite phenotype of phyB-deficient rice (Takano et al. (2005) *Plant Cell* 17: 3311-3325). Expression of YHB alleles in rice may thus be complementary to the use of PHYA to alter photomorphogenesis in rice Kong et al. (2004) *Mol. Breeding* 14: 35-45; Garg et al. (2006) *Planta* 223: 627-636). However, the interaction of YHB with the circadian clock may prove complex and unpredictable. We believe that with the appropriate choice of promoter, selective YHB expression may prove to be a useful tool to regulate the timing of flowering in a manner that is independent of both day-length and light quality.

Materials and Methods

Plant Materials, Growth Conditions and Phenotypic Analyses

*Arabidopsis* ecotype Landsberg erecta (Ler) wild type and phyA-201, phyB-5, phyA-201/phyB-5, hy1-1/phyA-201 and hy1-1/phyA-201/phyB-5 mutants (all in Ler ecotype) were obtained from colleagues or TAIR (www.arabidopsis.org). The Pro35S:AtPHYB-GFP expressing line PBG-5 in phyB-5 (Yamaguchi et al., 1999) was used as a control for fluorescence microscopy. Seedlings were grown at 20C on 0.8% (w/v) agar (Phytoblend, Caisson Laboratories) media containing half-strength of Mirashige-Skoog (MS) salt, half-strength of vitamin solution, 1% (w/v) sucrose unless stated otherwise. For hypocotyl length measurement, seedlings were grown on sucrose-free media containing 1×MS salt, 1× vitamin and 0.8% (v/w) agar for six days and hypocotyl lengths were measured using ImageJ software (//rsb.info.nih-.gov/ij/). Data represent the mean+/−s.d. (n=50). SNAP-LITE (Quantum Devices, Inc., Barneveld, Wis.) were used as light sources for red (662+/−15 nm) and far-red light (730+/−15 nm). Philips F48T12 cool white VHO 1LP fluorescent lights were used as the continuous white light (Wc) source with a fluence rate of 50-100 μmol $m^{-2}$ $s^{-1}$. For germination experiments, seeds were surface sterilized and sowed on top of four layers of moist filter papers, followed by treatment with saturated far-red light (18 μmol $m^{-2}$) and kept in dark at 4C for three days prior to the induction of germination. Imbibed seeds were kept at 20° C. in total darkness or treated with saturating pulses of red (1.5 mmol $m^{-2}$), far-red (5 mmol $m^{-2}$), red (1.5 mmol $m^{-2}$)/far-red (5 mmol $m^{-2}$) or red (1.5 mmol $m^{-2}$)/far-red (5 mmol $m^{-2}$)/red (1.5 mmol $m^{-2}$) followed by incubation in darkness at 23C for six days before germination efficiencies were scored. The mean of germination efficiency was calculated from at least three independent experiments (~100 seeds per experiment). For flowering time measurements, plants were grown under 8 h/16 h light/dark cycle. Total leaf number (rosette and cauline leaves) and rosette diameters were measured after bolting when the inflorescence reached 6-10 cm in height.

Plant Transformation Constructs

The AtPHYB cDNA plant transformation vector pJM61 was that described previously (Maloof et al. (2001) *Nat.*

*Genet.* 29: 441-446). Construction of the AtPHYB-YH$^c$ cDNA plant transformation vector entailed two cloning steps. The pBS-AtPHYB-YH$^c$-ST plasmid was initially constructed by mutagenizing the plasmid pBS-AtPHYB$^c$-ST (Fischer et al. (2005) *Biochem. ACS* 44: 15203-15215) using the QuikChange Site-Directed Mutagenesis Kit (Stratagene, La Jolla, Calif.) with forward and reverse primers 5'-GGT TAT GAT CGT GTT ATG GTT CAT AAG TTT CAT GAA GAT GAG C-3' (SEQ ID NO:143) and 5'-GCT CAT CTT CAT GAA ACT TAT GAA CCA TAA CAC GAT CAT AAC C-3' (SEQ ID NO:144). The mutagenized region was excised with BamHI and SpeI restriction enzymes and cloned into the similarly restricted AtPHYB-containing plant transformation vector pJM61 to generate pJM61YH. To generate AtPHYB-YH$^g$, AtPHYB-YI$^g$, AtPHYB-YQ$^g$ and AtPHYB-YR$^g$ genomic plant transformation constructs, the AtPHYB genomic DNA-containing plasmid pJM78 was used for site-directed-mutagenesis using the following forward and reverse primer sets: For YH$^g$ (see above); for YI$^g$ (5'-GGT TAT GAT CGT GTT ATG GTT ATT AAG TTT CAT GAA GAT GAG C-3' (SEQ ID NO:145) and 5'-GCT CAT CTT CAT GAA ACT TAA TAA CCA TAA CAC GAT CAT AAC C-3' (SEQ ID NO:146)); for YQ$^g$ (5'-GTT ATG ATC GTG TTA TGG TTC AAA AGT TTC ATG AAG ATG AGC-3' (SEQ ID NO:147) 5'-GCT CAT CTT CAT GAA ACT TTT GAA CCA TAA CAC GAT CAT AAC-3' (SEQ ID NO:148)); 5'-TTA TGA TCG TGT TAT GGT TCG TAA GTT TCA TGA AGA TGA GC-3' (SEQ ID NO:149) 5'-GCT CAT CTT CAT GAA ACT TAC GAA CCA TAA CAC GAT CAT AA-3' (SEQ ID NO:150)).

The mutagenized regions were excised with SacII and PstI and cloned into the similarly restricted AtPHYB genomic DNA-containing plant transformation vector pJM63 to generate plasmids pJM63YH, pJM63YI, pJM63YQ and pJM63YR. The *Arabidopsis* PHYA coding region was amplified with Pfu polymerase (Stratagene, La, Jolla, Calif.) using the forward and reverse primers, 5'-AGA GCT CAT GTC AGG CTC TAG GCC GAC T-3' (SEQ ID NO:151) and 5'-CTA GTC GAC CTA CTT GTT TGC TGC AGC GAG TTC-3' (SEQ ID NO:152) and the AtPHYA cDNA-containing plasmid pA2a, a kind gift of Joanne Chory (Salk Institute, La Jolla, Calif.), as the DNA template. The resulting PCR product was blunt-end cloned into pBluescript II KS+ restricted with EcoRV to yield pBS-AtPHYA$^c$. Plasmid pBS-AtPHYA-YH$^c$ was generated using the QuikChange Site-Directed Mutagenesis Kit with plasmid pBS-AtPHYA$^c$ as template and the following primers, 5'-GGT ATG ACA GGG TGA TGG CTC ATA AGT TTC ATG AAG ATG ATC AC-3' (SEQ ID NO:153) and 5'-GTG ATC ATC TTC ATG AAA CTT ATG AGC CAT CAC CCT GTC ATA CC-3' (SEQ ID NO:154). In order to express AtPHYA and AtPHYA-YH coding regions under the control of *Arabidopsis* PHYA promoter (Pro$^{AtPHYA}$), the *Arabidopsis* PHYA promoter was amplified with Pfu polymerase using Col genomic DNA as template and primers, 5'-GGA ATT CGA ATT GCG CTG TCT AGA TAA GA-3' (SEQ ID NO:155) and 5'-AGA GCT CGG ATC CCC TTT TTC CTG ACA CAG AGA C-3' (SEQ ID NO:156). The PCR product was blunt-end cloned into pBluescript II KS+ restricted with EcoRV to yield pBS-ProAtPHYA. The AtPHYA$^c$ coding region was restricted from pBS-AtPHYA$^c$ with SacI and SalI and the AtPHYA promoter region was restricted from $_{pBS\text{-}ProAtPHYA}$ with EcoRI and SacI. The two fragments were cloned into EcoRI and SalI restricted pCHF1 to yield pCHF1-Pro$^{AtPHYA}$:AtPHYA$^c$. An analogous strategy was used to generate pCHF1-Pro$^{AtPHYA}$:AtPHYA-YH$^c$.

Plant Transformation and Genetic Selection

*Arabidopsis* ecotype Landsberg erecta (Ler wild type), phyA-201, phyB-5, phyA-201/phyB-5 and hy1-1/phyA-201/phyB-5 were transformed with the floral dip technique using *Agrobacterium tumefaciens* strain GV3101 as the host (Clough and Bent (1998) *Plant J.* 16: 735-743). Transgenic plants were selected on solid media containing half-strength Mirashige-Skoog salt, half-strength vitamin solution, 1% (w/v) sucrose and 0.8% (w/v) agar (Phytoblend, Caisson Laboratories, Inc, Rexburg, Id.) containing 35 μg/mL kanamycin [for pJM61 (WT & YH) and pJM63 (WT, YH, YI, YQ & YR) AtPHYB constructs] or 100 μg/mL gentamycin [for pCHF1-based AtPHYA constructs]. Transgenic lines segregating approximately 3:1 for antibiotic-resistance in T2 generation were selected and T3 or T4 homozygous generation was used for photographs, protein extraction and phenotypic analyses.

Total Protein Extraction and Immunoblot Analysis

For total protein extraction, six-day-old dark-grown seedlings were frozen in liquid nitrogen, ground into powder and extracted with hot-SDS buffer (165 mM Tris-HCl, pH 6.8, 5.1% (w/v) SDS, 5 mM EDTA, 5 mM EGTA, 5% (v/v) 3-mercaptoethanol and 1 mM PMSF) and boiling for 1 min. Soluble fraction was clarified by centrifugation and proteins were precipitated by methanol-chloroform extraction (Wessel and Flugge (1984) *Anal. Biochem.* 138: 141-143). Protein pellets were dissolved in 50 mM Tris-HCl, pH 6.8 containing 2% (w/v) SDS and total protein concentration was determined by BCA Protein Assay Regent using bovine serum albumin as standard (Pierce, Rockford, Ill.). Equal amount of proteins were separated on SD S-PAGE (Laemmli, 1970) and electroblotted to PVDF membrane. Mouse monoclonal anti-PHYA 073D, anti-PHYB B6-B3 and anti-a-tubulin (Sigma, St. Louis, Mo.) antibodies were used for probing PHYA, PHYB and tubulin, respectively. After washing, blots were incubated with alkaline phosphatase-conjugated goat anti-mouse IgG (Santa Cruz Biotechnology, Inc. Santa Cruz, Calif.). Immunoreactive bands were visualized by incubating blots with NBT/BCIP reagent (Pierce, Rockford, Ill.).

RT-PCR Analysis

Total RNA was isolated from seven-day-old dark- and light-grown seedlings using TRIzol regent (Invitrogen, Carlsbad, Calif.). First strand cDNA was synthesized using StrataScript First-Strand Synthesis System (Stratagene, La Jolla, Calif.) and 1 L of first strand cDNA was used for 25 μL PCR reaction. CHLOROPHYLL A/B BINDING PROTEIN (CAB), CHALCONE SYNTHASE (CHS) and ACTIN (ACT) genes were amplified using the following primer sets: CAB-F: 5'-TAA GGC CGT CAA GCT TTC CCC-3' (SEQ ID NO:157) and CAB-R: 5'-TAC CAT GGG CTG CCT GAT GG-3' (SEQ ID NO:158) (Usami et al. (2004) *Plant Cell Physiol.* 45: 1798-1808). CHS-F: 5'-CGC ATC ACC AAC AGT GAA CAC-3' (SEQ ID NO:159) and CHS-R: 5'-TTC CTC CGT CAG ATG CAT GTG-3' (SEQ ID NO:160) (Mehrtens et al. (2005) *Plant Physiol.* 138, 1083-1096); Actin-F: 5'-ATG AAG ATT AAG GTC GTG GCA-3' (SEQ ID NO:161) and Actin-R: 5'-TCC GAG TTT GAA GAG GCT AC-3' (SEQ ID NO:162) (Abe et al. (2004) Plant Cell Physiol. 45, 211-220). PCR reactions were performed using the following cycle: 94° C., 2 min; 94° C., 30 sec, 56° C., 30 sec and 72° C. 40 sec for 35 cycles followed by 72° C., 10 min. 10 μL of PCR reactions were separated on 2% TAE gels and visualized with ethidium bromide staining.

Fluorescence Microscopy for Phytochrome Localization

Five-day-old dark- and light-grown (continuous white light, 80 μmole $m^{-2}$ $s^{-1}$) seedlings were stained with 50 ng/mL DAPI in PBS buffer for 30 min followed by destaining in PBS buffer for 10 min. DAPI-stained seedlings were transferred to a microscope slide immersed in PBS buffer under a cover slip and examination by fluorescence microscopy at the MCB Microscopy Imaging Facility. An Olympus FV1000 Laser Scanning Confocal Microscope equipped with LD violet diode laser (405 nm, 25 mW), Multi-line Ar laser (457 nm, 488 nm, 515 nm, Total 30 mW), a HeNe-G laser (543 nm, 1 mW) and a HeNe—R laser (633 nm, 10 mW) using DAPI (EX 405, EM 425/75), GFP (EX 488, EM500/55) and CY-5 (EX 633, EM 650LP) filter sets were used to visualize DNA, AtPHYB-GFP and AtPHYB-YH, respectively.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (162 sequences)

SEQ ID NO: 1 - protein, 1122 aa, Armoracia rusticana
MSGSRPSQSSEGSRRSRHSARIIAQTTVDAKLHADFEESGSSFDYSTSVRVTGPVVENQPPRSDKVTTTYLHHIQKGKLIQPFGCLLALDEKTFKVIAYSENAPELLTMASHAVPSVGEHPVLGIGTDIRSLFTAPSASALQKALGFGDVSLLNPILVHCKTSAKPFYAIVHRVTGSIIVDFEPVKPYEVPMTAAGALQSYKLAAKAITRLQSLPSGSMERLCDTMVQEVFELTGYDRVMAYKFHEDDHGEVVSEVTKPGMEPYLGLHYPATDIPQAARFLFMKNKVRMIVDCNAKHARVLQDEKLSFDLTLCGSTLRAPHSCHLQYMANMDSIASLVMAVVVNEEDGEGDAPDSTTQPQKRKRLWGLVVCHNTTPRFVPFPLRYACEFLAQVFAIHVNKEVELENQIVEKNILRTQTLLCDMLMRDAPLGIVSQSPNIMDLVKCDGAALLYKDKIWKLGTTPSEFHLQEIASWLYEYHTDSTGLSTDSLYDAGFPKALSLGDAVCGMAAVRISSKDMIFWFRSHTAGEVRWGGAKHDPDDRDDARRMHPRSSFKAFLEVVKTRSLPWKDYEMDAIHSLQLILRNAFKDGESTDVNTKFIHSKLNDLKIDGIQELEAVTSEMVRLIETATVPILAVDSDGLVNGWNTKIAELTGLPVDEAIGKHLLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQTACCRLKNQEAFVNLGIVLNSAVTSQESEKVSFAFFTRGGKYIECLLCVSKKLDREGVVTGVFCFLQLASHELQQALHVQRLAERTALKRLKTLAYIKRQIRNPLSGIMFTRKMMEGTELGPEQRQILQTSSLCQKQLSKVLDDSDLERIIEGCLDLEMKEFSLNEVLTASTSQVMMKSNGKSVRITNETGEEVMSDTLYGDSIRLQQVLADFMLMSVNFTPSGGQLTVTASLRKDQLGRSVHLAYLEIRLTHTGAGIPELLLNQMFGTEKDVSEEGLSLMVSRKLVKLMNGDVQYLRQAGKSSFIISAELAAANK

SEQ ID NO: 2 - protein, 1129 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFSEITKPGLEPYLGLHYPATDIPQAARLLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGTPNIMDLVKCDGAALLYGGKVWRLRNAPTESQIHDIAFWLSDVHRDSTGLSTDSLHDAGYPGAAALGDMICGMAVAKINSKDILFWFRSHTAAEIRWGGAKNDPSDMDDSRRMHPRLSFKAFLEVVKMKSLPWSDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEDSSVPVVQRMLYLALQGKEEKEVRFEVKTHGPKRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNRDAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSITEKSSCLDLEMAEFLLQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMAQMFEEDNKEQSEEGLSLLVSRNLLRLMNGDVRHLREAGVSTFIITAELASAPTAMGQ

SEQ ID NO: 3 - protein, 1129 aa, Avena sativa
MSSSRPASSSSSRNRQSSRARVLAQTTLDAELNAEYEESGDSFDYSKLVEAQRDGPPVQQGRSEKVIAYLQHIQKGKLIQTFGCMLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFAEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQQKKKLWGLLVCHHESPRYVPFPLRYACEFLAQVFAVHVNREFELEKQLREKSILKMQTMLSDMLFREASPLTIVSGAPNIMDLVKCDGAALLYGGKVWRLRNAPTESQIHDIAFWLSDVHRDSTGLSTDSLHDAGYPGASALGDMICGMAVAKINSKDIIFWFRSHTAAEIRWGGAKHDSSDMDDSRRMHPRLSFKAFLEVVKMKSLPWTDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEESSVPVVQRMLYLALQGKEEKEVRFEVKTHGPRRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNKNAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSISEKSSCLDLEMAEFVFQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMEQMFEEDNKEQSDEGLGLLVSRKLLRLMNGDVRHLREAGVSTFILTAELASAPTAIGQ

SEQ ID NO: 4 - protein, 1122 aa, Arabidopsis thaliana
MSGSRPTQSSEGSRRSRHSARIIAQTTVDAKLHADFEESGSSFDYSTSVRVTGPVVENQPPRSDKVTTTYLHHIQKGKLIQPFGCLLALDEKTFKVIAYSENASELLTMASHAVPSVGEHPVLGIGTDIRSLFTAPSASALQKALGFGDVSLLNPILVHCRTSAKPFYAIIHRVTGSIIIDFEPVKPYEVPMTAAGALQSYKLAAKAITRLQSLPSGSMERLCDTMVQEVFELTGYDRVMAYKFHEDDHGEVVSEVTKPGLEPYLGLHYPATDIPQAARFLFMKNKVRMIVDCNAKHARVLQDEKLSFDLTLCGSTLRAPHSCHLQYMANMDSIASLVMAVVVNEEDGEGDAPDATTQPQKRKRLWGLVVCHNTTPRFVPFPLRYACEFLAQVFAIHVNKEVELDNQMVEKNILRTQTLLCDMLMRDAPLGIVSQSPNIMDLVKCDGAALLYKDKIWKLGTTPSEFHLQEIASWLCEYHMDSTGLSTDSLHDAGFPRALSLGDSVCGMAAVRISSKDMIFWFRSHTAGEVRWGGAKHDPDDRDDARRMHPRSSFKAFLEVVKTRSLPWKDYEMDAIHSLQLILRNAFKDSETTDVNTKVIYSKLNDLKIDGIQELEAVTSEMVRLIETATVPILAVDSDGLVNGWNTKIAELTGLSVDEAIGKHFLTLVEDSSVEIVKRMLENALEGTEEQNVQFEIKTHLSRADAGPISLVVNACASRDLHENVVGVCFVAHDLTGQKTVMDKFTRIEGDYKAIIQNPNPLIPPIFGTDEFGWCTEWNPAMSKLTGLKREEVIDKMLLGEVFGTQKSCCRLKNQEAFVNLGIVLNNAVTSQDPDKVSFAFFTRGGKYVECLLCVSKKLDRKGVVTGVFCFLQLASHELQQALHVQRLAERTAVKRLKALAYIKRQIRNPLSGIMFTRKMIEGTELGPEQRRILQTSALCQKQLSKILDDSDLESIIEGCLDLEMKEFTLNEVLTASTSQVMMKSNGKSVRITNETGEEVMSDTLYGDSIRLQQVLADFMLMAVNFTPSGGQLTVSASLRKDQLGRSVHLANLEIRLTHTGAGIPEFLLNQMFGTEEDVSEEGLSLMVSRKLVKLMNGDVQYLRQAGKSSFIITAELAAANK

SEQ ID NO: 5 - protein, 1124 aa, Cucurbita pepo
MSTSRPSQSSSNSGRSRHSTRIIAQTSVDANVQADFEESGNSFDYSSSVRVTSDVSGDQQPRSDKVTTAYLHHIQKGKLIQPFGCLLALDDKTFKVIAYSENAPEMLTMVSHAVPSMGDYPVLGIGTDVRTIFTAPSASALLKALGFGEVTLLNPILVHCKTSGKPFYAIVHRVTGSLIIDFEPVKPYEGPVTAAGALQSYKLAAKAITRLQSLPSGSMARLCDTMVQEVFELTGYDRVMAYKFHDDDHGEVISEVAKPGLQPYLGLHYPATDIPQAARFLFMKNKVRMIVDCRAKHLKVLQDEKLQFDLTLCGSTLRAPHSCHLQYMENMNSIASLVMAVVVNEGDEENEGPALQQQKRKRLWGLVVCHNSSPRFVPFPLRYACEFLAQVFAIHVNKELELENQIIEKNILRTQTLLCDMLMRDAPLGIVSRSPNIMDLVKSDGAALLYKKKIWRLGLTPNDFQLLDIASWLSEYHMDSTGLSTDSLYDAGYPGAIALGDEVCGMAAVRITNNDMIFWFRSHTASEIRWGGAKHEHGQKDDARKMHPRSSFKAFLEVVKTRSLPWKDYEMDAIHSLQLILRNTFKDTDATEINRKSIQTTLGDLKIEGRQELESVTSEMVRLIETATVPILAVDLDGLINGWNTKIAELTGLPVDKAIGKHLLTLVEDSSVEVVRKMLFLALQGQEEQNVQFEIKTHGSHIEVGSISLVVNACASRDLRENVVGVFFVAQDITGQKMVMDKFTRLEGDYKAIVQNPNPLIPPIFGSDEFGWCSEWNPAMAKLTGWSREEVIDKMLLGEVFGVHKSCCRLKNQEAFVNLGIVLNNAMCGQDPEKASFGFLARNGMYVECLLCVNKILDKDGAVTGFFCFLQLPSHELQQALNIQRLCEQTALKRLRALGYIKRQIQNPLSGIIFSRRLLERTELGVEQKELLRTSGLCQKQISKVLDESDIDKIIDGFIDLEMDEFTLHEVLMVSISQVMLKIKGKGIQIVNETPEEAMSETLYGDSLRLQQVLADFLLISVSYAPSGGQLTISTDVTKNQLGKSVHLVHLEFRITYAGGGIPESLLNEMFGSEEDASEEGFSLLISRKLVKLMNGDVRYMREAGKSSFIITVELAAAHKSRTT

SEQ ID NO: 6 - protein, 1119 aa, Cuscuta pentagona
MSSSRPSQSSSNSARSKHSARIIAQTSIDAKLHAEFEESGDSFDYSSSIRVTSVNTGEQKPRSDKVTTAYLHQIQKAKFIQPFGCLLALDEKTFRVIAFSENAPDMLTMVSHAVPSVGDLPVLGIGTDIRTIFTAPSGAALQKALGFGEVSLLNPILVHCKTSGKPFYAIVHRVTGSLIVDFEPVKPYEAPMTAAGALQSYKLAAKAIARLQSLPSGSLERFCDTIVQEVFELTGYDRVMAYKFHDDDHGEVVSEITKPGLEPYLGLHYPATDIPQAARFLFMKNKVRMICDCQAKHVKVVQDEKLLFDLTLCGSTLRAPHTCHLQYMENMNSIASLVMAIVVNDGDDEEEEERSGSGKRKRLWGLVVCHNTTPRFVPFPLRYACEFLAQVFAIHVNKELELENQIVEKNILRTQTLLCDILLRDAVLGIVSQSQSPNMMDLVKCDGAVLLYKSKIHRLGITPTDFQLQDIVYRLNEHHMDSTGLSTDSLYDAGFPGALSLGLCGMASVRISEKDWLFWFRSHTASEVRWGGVKHEPDDGRKMHPRSSFKAFLEVVETRSLPWKDYEMDGIHSLQLIMRNAFFNEADTVATNVIHAKLNDLRIDGLQELEAVTSEMVRLIETAMVPIIAVGVDGLVNGWNTKIAELTGLSVDEAIGNHLLTLVEDSSVHTVKKMLNLALQGEEEKNVQFEIMTHGIRSECGPISLVVNACASRDVQESVVGVCFIAQDITGQKTVMDKFTRIEGDYRAIIQNPNPLIPPIFGTDEFGWCSEWNSAMTKLSGWRRDEVIDKMVLGEVFGTQKACCRLKSHEAFVTLGVVLNNAITGHESDKTVFGFCTRNGKYVECLLSVTKRLNQDGAVIGLFCFLQLASQELQQALHFQKLSEQTATKRLKVLAYLRKQVKNPLSGIMFSRKMLEGTELGNDQQNILHTSAQCQQQLSKVLDDTDLDCIIEGYLDLEMVEFKLDEVLLASISQVMTKSNGKSLRVINDVAENVLCETLYGDSLRLQQVLAEFLSVAVNFTPSGGQLAVSSSLTKDHLGQSVQLAHLEFRVTHSGGGVPEELLTQMFGSDVDALEEGISLLVSRNLVKLMNGDVQYHREAGRSAFIISVELAVATKPRA

SEQ ID NO: 7 - protein, 1131 aa, Glycine max
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIRAKLLKLMNGDVRYLREAGKSAFILSAELAAAHNLKA

SEQ ID NO: 8 - protein, 1123 aa, Lycospericum esculentum
MSSSRPSQSSTTSSRSKHSARIVAQTSIDAKLHADFEESGDSFDYSSSVRVTSVAGDEEKPKSDKVTTAYLHQIQKGKFIQPFGCLLALDEKTLKVIAFSENAPEMLTMVSHAVPSVGEHPVLGIGTDIRTIFTGPSGAALQKALGFGEVSLLNPVLVHCKNSGKPFYAIVHRVTGSLILDFEPVKPYEVPMTAAGALQSYKLAAKAITRLQSLPSGSMERLCDTMVQEVFELTGYDRVMGYKFHEDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLQDIVSWLCEYHTDSTGLSTDSLYDAGFPGALALGDAVCGMAAVRISDKDWLFWFRSHTAAEVRWGGAKHEPGEKDDGRKMHPRSSFKAFLEVVKTRSIPWKDYEMDAIHSLQLILRNAFKDAEVVNSNTNSIYKKLNDLKIDGMQELESVTAEMVRLIETALVPILAVDVDGQVNGWNTKIAELTGLPVDEAIGKHLLTLVEDSSVDTVNKMLELALQGKEEKNVEFEIKTHGPSRDSSPISLIVNACASKDVRDNVVGVCFMAHDITGQKSIMDKFTRIEGDYRAIIQNPHPLIPPIFGTDQFGWCSEWNTAMTKLTGWRRDDVMDKMLLGEVFGTQAACCRLKNQEAFVNFGVVLNNAITGQESEKIPFGFFARYGKYVECLLCVSKRLDKEGAVTGLFCFLQLASHELQQALYVQRLSEQTALKRLKVLAYIRRQIRNPLSGIIFSRKMLEGTSLGEEQKNILHTSAQCQRQLNKILDDTDLDSIIDGYLDLEMLEFKLHEVLVASISQVMMKSNGKNIMISNDMVEDLLNETLYGDSPRLQQVLANFLLVSVNATPSGGQLSISGRLTKDRIGESVQLALLEFRIRHTGGGVPEELLGQMFGSEADASEEGISLLVSRKLVKLMNGEVQYLREAGQSTFIISVELAVATNSS

SEQ ID NO: 9 - protein, 1124 aa, Lathyrus sativus
MSTTRPSQSSNNSGRSRNSARIIAQTTVDAKLHATFEESGSSFDYSSWVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTEYQIREIALWMSEYHTDSTGLSTDSLLDAGFPGALSLSDTVCGMAAVRITSKDIVFWFRSHTAAEIRWGGAKHEPGEQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVEFGPISLIVNACASRDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVAFGFFSRKGKYVECLLSVSKKIDAEGLVTGVFCFLQLASPELQQALHIQRLSEQTALKRLKVLTYMKRQIRNPLAGIVFSSKMLEGTDLETEQKQIVNTSSQCQRQLSKILDDSDLDGIIDGYLDLEMAEFTLHEVLVTSLSQVMNRSNTKGIRIANDVAEHIAKESLYGDSLRLQQVLADFLLISINSTPNGGQVVIASSLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 10 - protein, 1130 aa, Monotropastrum globosum
MSSSRPTQSSGSSGRSKHSARIIAQTTVDAKLHADFEESGGSFDYSTSVRFTGTVGGDIQPRSDKVTTAYLHQIQRGKLIQPFGCLLAVDEKTFKVIAYSENAPEMLTMVSHAVPSVGDHPLLGIGTDVRTIFTNPSAAALQKAMGYGEVSLLNPILVHCKTSGKPFYAIVHRVTGSLIIDFEPVKPYEVPMTAAGALQSYKLAAKAITRLQSLPSGNMRILCDAMVQEVFELTGYDRVMVYKFHDDDHGEVFSELTKPGLEPYLGLHYPATDIPQAARFLFMKNKIRMICDCHAKQVKVIQDDKLPIDLTLCGSTLRAPHSCHLQYMENMNSIASLVMSVVVNEGDEEGDGGGSSVSSNQQQKIKRLWGLLVCHNTTPRFVPFPLRYACEFLAQVFTIHVNKELELENQIHEKNILRTQTLLCDMLMRDAPLGIVSQSPNVMDLVKCDGAVLLYKDKTYRMGTTPTDFQLRDIVYWLSEYHTDSTGLSTDSLYDAGYPGALAFGDGVCGMAAVKITSNDMLFWFKAQTAAEIQWGGAKHESGERDDGRKMHPRSSFKAFLEVVKTRSLPWKDYEMDAIHSLQLILRNAFKDTKAMDATTDVIHTRLHDLKIEGMEELEAVTSEMVRLIETATVPILAVDVDGLVNGWNLKIAELTGLPVDKAIGRDLLSLVEDSSTGIVKKMLDLALQGKEEQNIQFELKTDESRRDSGPISLVVNACASRDHHENVVGVCFVAQDITGHKTVMDKFTRIEGDYKAIVQNPNPLIPPILGTDEFGWCSEWNLAMEKISGWNREDVINKMLLGEVFGTHVVCCRLKNQEAFVNLGIVLNNAVTGRESEKISFGFFARNGKYVECILCASKKIDGEGAVTGVFCLLQLASPELQQALHVQRLTEQTALKRFKELAYIRRQTRASLSGIMYSWRLMEGTDLRERQKQLLHTSAQCQHQLTKILDDTDLDCIIDGYLDLEMVEFTLYEVLSASISQVTLKSNGKGIHIANPLQEEKMPATLYGDNLRLQQVIADFLSISVNFTPNGGQIVASASLTKDRLGQSVQLVHVEIRITHMGGGVPEGLLNQMFGGDTDTSEEGISLLVSRKLVKLMNGDVQYLREAGKSTFIISVELAAAANKSTCE

SEQ ID NO: 11 - protein, 1124 aa, Nicotiana tabacum
MSSSRPSQSSTTSARSKHSARIIAQTTIDAKLHADFEESGDSFDYSSSVRVTSVAGDERKPKSDRVTTAYLNQIQKGKFIQPFGCLLALDEKTFKVIAFSENAPEMLTMVSHAVPSVGELPALGIGTDIRTIFTGPSAAALQKALGFGEVSLLNPVLVHCKTSGKPYYAIVHRVTGSLIIDFEPVKPYEVPMTAAGALQSYKLAAKAITRLQALPSGSMERLCDTMVQEVFELTGYDRVMTYKFHDDDHGEVVAEITKPGLDPYLGLHYPATDIPQAARFLFMKNKVRMICDCRAKHVKVVQDEKLPFDLTLCGSTLRAPHYCHLQYMENMSSIASLVMAVVVNDGDEEGESSDSTQSQKRKRLWGLVVCHNTTPRFVPFPLRYACEFLAQVFAIHVNKELELESQILEKNILRTQTLLCDMLMRVAPLGIVSQSPNIMDLVKCDGAALLYKNKIHRLGMTPSDFQLHDIVSWLSEYHTDSTGLSTDSLYDAGFPGALALGDVVCGMAAVRISDKGWLFWYRSHTAAEVRWGGAKHEPGEKDDGRKMHPRSSFKAFLEVVKTRSVPWKDYEMDAIHSLQLILRNASKDADAMDSNTNIIHTKLNDLKIDGLQELEAVTAEMVRLIETASVPIFAVDVDGQLNGWNTKIAELTGLPVDEAIGNHLLTLVEDSSVDTVSKMLELALQGKEERNVEFEIKTHGPSGDSSPISLIVNACASRDVGDSVVGVCFIAQDITGQKNIMDKFTRIEGDYRAIIQNPHPLIPPIFGTDQFGWCSEWNSAMTKLTGWRRDDVIDKMLLGEVFGTQAACCRLKNQEAFVNFGVVLNNAMTGQECAKISFGFFARNGKYVECLLCVSKRLDREGAVTGLFCFLQLASHELQQALHIQRLSEQTALKRLKVLAYIRRQIRNPLSGIIFSRKMLEGTNLGEEQKNILRTSSQCQRQLNKILDDTDLDSIIDGYLDLEMLEFKLHEVLVASISQIMMKSNGKNIMIVNDMVEDLLNETLYGDSPRLQQVLANFLLVCVNSTPSGGQLSISGTLTKDRIGESVQLALLEVRISHTGGGVPEELLSQMFGTEAEASEEGISLLISRKLVKLMNGEVQYLREAGRSTFIISVELAVATKSSC

SEQ ID NO: 12 - protein, 1123 aa, Orobanche minor
MASSQPGRSSTNSAQSRQSARIIAQTSIDAKLDADFEESGSSFDYSTSVRVTNYPAGLSEPRSDKVTTAYLHQIQKGKLIQQFGCLLALDEKTFRVIAYSENAPEMLTMVSHAVPSVGDHPLLGIGSDIRTIFTAPSAAALQKALGFGEVSLLNPILVHCKTSGKPFYAIIHRVTGSLIIDFEPVKPHEVPMTAAGALQSYKLAAKAIACLQALPGGSIERLCDTMVQQVFELTGYDRVMIYKFHEDDHGEVFTEITKPGLEPYVGLHYPATDIPQAARFLFMKNKVRMICDCRANHVKVVQDDNLPFDLTLCGSTLRAPHGCHSQYMENMNSIASLVMSVVVNEGDEDGPDSSSGPYKRKRLWGLVVCHNTCPRFIPFPLRYACEFLVQVFSIHVNKELELENQMLEKNILRTQTLLCDLLLRDVPLGIVSQSPNVMDLVKCDGAILLHKRTKYRLGLTPTDFQIRDIVSWLDEYHQDSTGLSTDSLYDAGFPGALALGNALCGMAAVKITDEDWLFWFRSHTAAEIRWGGAKHELEAKDDGRKMHPRSSFRAFLEVVKTRSLPWKDYEMDGIHSLQLILRNAYKESEEKDLESREIHARLNELQIDGVKEIEAVTSEMVRLIETATVPIFSVGVDGLVNGWNTKISDLTGLSVVEAIGMHFLALVEDSSADTVSKMLGLALQGKEEHDVQFEIKTHGQRSESGPISLIVNACASKDVKENVVGVCFIAQDITTQKSMMDKFTRIEGDYRSIIQNPNPLIPPIFGTDEFGWCSEWNAAMIKLSGWGREAVIDKMLLGEVFGLNKACCRLKNQEAYVNLGVVLNNTVTGQESGKVSFGFFSRSGKYVACLLCVSKKVDSEGSVTGLFCFLQLASPELQQALHIQRISEQTASKRLRVLAYIRREIRSPLSGIIFSRKLMEGTDLNDEQKNIVRTSLHCQSQMNKILEDTDLDHIIEGYLDLEMVEFKLHEVLIASISQVISKSNGKGIKIVDNLAPNLSNETLYGDSLRLQQVLAAFLLIAVDSTPSGGQLGVAATLAKDSIGEFVQLGRLECRITHGGGVPQEILNQMFGDEPTDASEDGISLFISRKLVKLMKGDIQYLREAGRSTFIISVEIAISNKPNL

SEQ ID NO: 13 - protein, 1128 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVRSLFTDPGTTALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 14 - protein, 1129 aa, Petroselinum crispum
MSSSRPANSSSNPGRANQNARVVLTTLDAKIHADFEESGNSFDYSSSVRVTSAVGENSSIQSNKLTTAYLHHIQKGKLIQPVGCLLAVDEKSFKIMAYSENAPEMLTMVSHAVPSVGEHPVLGIGTDVRTIFTAPSAAALQKAVGFTDINLLNPILVHCKTSGKPFYAIAHRVTGSLIIDFEPVKPYEVPMTAAGALQSYKLASKAVNRLQALPGGSMERLCDTMVQEVFELTGYDRVMAYKFHDDDHGEVTAEVTKPGLEPYFGLHYPATDVPQAARFLFLKNKVRMICDCRANSAPVLQDEKLPFELTLCGSTLRAPHSCHLQYMENMNSIASLVMAVVINDSDEVVESSDRNSVKSKKLWGLVVCHNTSPRFVPFPLRYACEFLAQVFAIHVSKELELENQIVEKNILRTQTLLCDLLMRDAPLGIVSQSPNMMDLVKCDGAALLYKNKVYRLGATPSDYQLRDIVSWLTEYHTDSTGLSTDSLYDAGYPGALALGDVVCGMAVVKITSHDMLFWFRSHAAGHIRWGGAKAEPDENHDGRKMHPRSSFKAFLEVVKTRSTTWKEFEMDAIHSLQLILRKALSVEKAVAAQGDEIRSNTDVIHTKLNDLKIEGIQELEAVTSEMVRLIETATVPIFAVDADEIVNGWNTKIAELTGLPVDQAMGKHLLTLVEDSSVGTVVFLLALALQGKEEQGIPFEFKTYGSREDSVPITVVVNACATRGLHDNVVGVCFVAQDVTSQKTIMDKFTRIQGDYKAIVQNPNPLIPPIFGTDEFGWCSEWNQAMTELSGWRREDVMNKMLLGEIFGIQTSCCHLKSKEAFVNLGVVLNNALTGQISEKICFSFFATDGKYVECLLCASKKLHGEGTVTGIFCFLQLASQELQQALHIQRLTEQTAMKRLKTLSYLRRQAKNPLCGINFVREKLEEIGMGEEQTKLFRTSVHCQRHVNKILDDTDLDSIIDGYLDLEMSEFRLHDVYVASRSQVSMRSNGKAIQVVDNFSEEMMSETLYGDSLRLQKVLADFMSVCVNLTPVGGHLGISVTLTEDNLGQSVQLVHLEFRITHTGAGVPEEAVSQMFGSDSETSEEGISLLISRKLVKLMNGDVHYLREAGKSTFIITVELAAASKRES

SEQ ID NO: 15 - protein, 1124 aa, Pisum sativum
MSTTRPSQSSNNSGRSRNSARIIAQTTVDAKLHATFEESGSSFDYSSSVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTESQLREIALWMSEYHTDSTGLSTDSLSDAGFPGALSLSDTVCGMAAVRITSKDIVFWFRSHTAAEIRWGGAKHEPGDQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVESGPISLIVNACASKDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVPFGFFSRKGKYVECLLSVSKKIDAEGLVTGVFCFLQLASPELQQALHIQRLSEQTALKRLKVLTYMKRQIRNPLAGIVFSSKMLEGTDLETEQKRIVNTSSQCQRQLSKILDDSDLDGIIDGYLDLEMAEFTLHEVLVTSLSQVMNRSNTKGIRIANDVAEHIARETLYGDSLRLQQVLADFLLISINSTPNGGQVVIAASLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 16 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 17 - protein, 1122 aa, Stellaria longipes
MASRAQSQSSTNSGRSKHSARIIAQTIQDAKFHAEFEESSNEFDYSSSVRGSTSGVNQLPKSDKVTSSYLLQIQKGKFIQPFGCLLALDDKTFRVIAFSENAPEMLTMVSHAVPSVGDLPVIGIGTDIRTIFTGPSASALQKALGFTDVSLLNPILVHCKNSGKPFYAIVHRVTRSLVIDFEPVKPYEVPMTAAGALQSYKLAAKAITRLQSLPSGNMVRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLIRDAPLGIVTHSPNIMDLVKCDGAALLYNNKVWRLGSTPTDYQLQEIGGWLSRDHMDSTGLSTDSLYDAGYPAALELGDSVCGMAAVSITVNDMLFWFTSHTAAEIKWGGAKHEAGEKDDGSKMHPRSSFKAFLEVVKRRSVPWKDYEMDAIHSLQLILRNAFKDGEAADLNTSVIHSKISDLQISGLKELEAVTSEMVRLIETATVPIFAVDSDGLVNGWNTKIYELTGIPVEEAVGKHIAALVEDSSIDNVKQMLQSALQGEEKKNVQFEVKRHHSIPDSGPISLIVNACASKDVNGNVVGVCLIAQDITGQKTVMDKFLRIEGDYKAIIQSPNPLIPPIFGTDEFGWCSEWNPAMAKLTGWTREEVIDKMLLGEVFGMHKSCCRLKNQEAFVNLGVLLNGAMSGQNIEKLSIGFFTRSGKYIECLLCVNKKLNGEGDVTGVFCFLQLASHDLQHALHIQRLAEQAATKRANVLAYMKRQIKNPLAGIIFSGKILDGTNVDEKQRLVLQTSARCQGQLNKILDDSDLDSIIDGYCELEMVEFAVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTSTFIISVELAVAGNSS

SEQ ID NO: 18 - protein, 1123 aa, Stellaria longipes
MASPAQSQSSTNSGRSKHSARIIAQTIQDAKLHAEFEESSNEFDYSSSVRGSTSGVNQLPQSDKVTSSYLLQIQKGKFIQPFGCLLALDDKTFRVIAFSENAPEMLTMVSHAVPSVGDLPVIGIGTDIRTIFTDPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELESQFLEKKILRTQTLLCDMLMRDAPLGIVTQNPNVMDLVKCDGAALLYNNKIWKLGISPTDYQLRDIAGWLSRDHTDSTGLSTDSLHDAGYPGARSLGDTVCGMAAVRITLNNMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKIFELTGVPVAEAVGKHIASLAEESSIDNVKRMLQLALQGEEKKNVQFEIKRHQSNPDSSPISLVVNACASKDVNGNVVGVCLITQDITGQKTVMDKFTRIEGDYKAIIQSPNPLIPPIFGTDEFGWCSEWNPAMAKLTGWSREEVIDKMLLGEVFGTQKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASTCQVMAKSNEKGIQIANDSTTEHGLKETLYGDSLRLQQILADFLWISVNFTPAGGNVGIKVRLTKDKIGESIQHANLEFRISHTGGGISEELLSQMFENQGEVSEEGISLLVSRKIVKLMNGDVQYLRSAGSSTFIISVELAIAGNSL

SEQ ID NO: 19 - protein, 1122 aa, Stellaria longipes
MASPAQSQSSTNSGRSKHSARIIAQTIQDAKLHAEFEESSNEFDYSSSVRGSTSGVNQLPKSDKVTSSYLLQIQKGKFIQLFGCLLALDDKTFRVIAFSENAPEMLTMVSHAVPSVGDLPVIGIGTNIRTIFTGPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGIVTQNPNVMDLVKCDGAALLYNNKIWKLGITPTDYQLRDIAGWLSRDHTDSTGLSTDSLHDAGYPGARSLGDTVCGMAAVRITPNDMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKISELTGVPVAEAVGKHIASLAEESSIDNVKRMLQLALQGEEKKNVQFEIKRHQSNPDSGPISLVVNACASKDVNGNVVGVCLIAQDITGQKTVMDKFTRIEGDYKAIIQSPNPLIPPIFGTDEFGWCSEWNPAMAKLTGWSREEVIDKMLLGEVFGTHKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTCTFIIYVELAVADNSS

SEQ ID NO: 20 - protein, 1123 aa, Solanum tuberosum
MSSSRPSQSSTTSSRSKHSARIIAQTSIDAKLHADFEESGDSFDYSSSVRVTNVAEGEQRPKSDKVTTAYLHQIQKGKFIQPFGCLLALDEKTLKVIAFSENAPEMLTMVSHAVPSVGEHPVLGIGIDIRTIFTGPSGAALQKALGFGEVSLLNPVLVHCKNSGKPFYAIVHRVTGSLIIDFEPVKPYEVPMTAAGALQSYKLAAKAITRLQSLPSGSMERLCDTMVQEVFELTGYDRVMGYKFHDDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVSHNTTPRFAPFPLRYACEFLAQVFAILVNKELELENQFLEKNILRTQTLLCDMLMRDAPLGIVSQSPNIMDLIKCDGAALLYKNKIHRLGMNPSDFQLHDIVSWLCEYHTDSTGLSTDSLYDAGFPGALALGDAVCGMAAVRISDKDWLFWYRSHTAAEVRWGGAKHEPGEKDDGRKMHPRSSFKGFLEVVKTRSIPWKDYEMDRIHSLQLILRNAFKDADAVNSNTISIHTKLNDLKIDGMQELEAVTAEMVRLIETASVPIFAVDVDGQVNGWNTKVAELTGLPVDEAIGKHLLTLVEDSSVDTVNKMLELALQGQEERNVEFEIKTHGPSRDSSPISLIVNACASKDVRDSVVGVCFIAQDITGQKSIMDKFTRIEGDYRAIIQNPHPLIPPIFGTDQFGWCSEWNSAMTMLTGWRRDDVMDKMLLGEVFGTQAACCRLKNQEAFVNFGVILNNAITGQESEKIPFGFFARYGKYVECLLCVSKRLDKEGAVTGLFCFLQLASHELQQALHVQRLSEQTALKRLKVLAYIRRQIRNPLSGIIFSRKMLEGTSLGEEQKNILHTSAQCQRQLDKILDDTDLDSIIEGYLDLEMLEFKLHEVLVASISQVMMKSNGKNIMISNDMVEDLLNETLYGDSPRLQQVLANFLLVSVNSTPSGGKLSISGKLTKDRIGESVQLALLEFRIRHTGGGVPEELLSQMFGSEADASEEGISLLVSRKLVKLMNGEVQYLREAGRSTFIISVELAVATKSS

SEQ ID NO: 21 - protein, 1130 aa, Triticum aestivum
MSSSRAASSSSSRNRQSTQERVLAQTTLDAELNAEFEESSDSFDYSKLVEAQRDTPTVLQEGRSEKVIAYLQHIQRGKMIQSFGCLLALDEKSFNVIAFSENAPEMLTTVSHAVPSVDDPPRLDIGTNVRSLFTDQGAAALHKALGFADVSLLNPILVQCKTSGKPFYAIVHRATGCLVVDFEPVNPTEFPATAAGALQSYKLAAKAISKIQALPGGSMELLCNTVVKEVFDLTGYDRVMAYKFHEDNHGEVFAEITKPGLEPYLGLHYPATDIPQAARFLFMKNKVRLICDVRARPIKVIEDEALPFDISLCGSALRAAHSCHLQYMENMNSIASLVMAVVVNENEEDDEVGSEQPAQQQKKKILWGLIVCHHESPRYVPFPLRYACEFLAQVFAVHVNKEFEVQKQLREKSILRMQTILSDMLFKEASPLTIVSGAPNIMDLIKCDGAALLYGGKVWRLGTAPTESQIRDLALWLSEVHMDSTGLSTESLHDAGYPGASALGDTVCGMAVAKINSSDILFWFRSPTAKEIRWGGAKNDPSDMDDSRRMHPRLSFKAFLEVVKMKSLAWTDSEMDAIHSLQLILRGAVDGVVKPTGKASLDEQIGDLKLDGLAELQAVTSEMVRLMETATVPILAVDGNGLVNGWNQKAAELTGLRVDDAIGRHILTLVEESSVSVVQRMLYLALQGKEEKEVRFEVKTHGPKRDDGPVILVVNACASRDLHDDVVGVCFVAQDMTVHKLVMDKFTRVEGDYMAIIHNPNPLIPPIFGADESGWCCEWNAAMTKLTGWHREEVLDKMLLGEVFDSRNASCLLKNKDAFVSLCVVINSALAGEETEKAPFGFFDRSGKYTECLLSVNRRQNEGGLITGVFCFIHIPSHELQQALQVQQASEQKSLKRLKAFSYMRHAINNPLSGMLYSRKALKNTDLNEEQMRQIHVADNCHHQLNKILADLDQHNIMEKSSCLDLEMAEFVLQDVVVAAVSQVLIACQGKGIRVSCNLPERFMKQLVYGDGVRLQQILSDFLSISVKFSPVGSSVEISAKATKNSIGENLHLIDLELRIKHQGLGVPAELMAQMFEEDEPQQSEEGLGLLVSRNLLRLMNGDVRHLREAGVSIFILTAELACAPTAMEH

SEQ ID NO: 22 - protein, 1131 aa, Zea mays
MSSLRPAQSSSSSSRTRQSSQARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMQALCNTVVKEVFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEDDDEPESEQPPQQQKRKKLWGLIVCHHESPRYVPFPLRYACEFLAQVFAVHVNKEFELEKQIREKSILRMQTMLSDMLFKESSPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDEDDSRRMHPRLSFKAFLEVVKMKSLPWSDYEMDAIHSLQLILRGTLNDALKPAQSSGLDNQIGDLKLDGLAELQAVTSEMVRLMETATVPILAVDGNGLVNGWNQKVADLSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTDLDEEQMRQVRVADNCHRQLNKILADLDQDNITDKSSCLDLDMAEFVLQDVVVSAVSQVLIGCQGKGIRVACNLPERSMKQKVYGDGIRLQQILSDFLFVSVKFSPAGGSVDISSKLTKNSIGENLHLIDFELRIKHQGAGVPAEILSQMYGEDNREQSEEGLSLLVSRNLLRLMNGDIRHLREAGMSTFILTAELAAAPSAAGH

SEQ ID NO: 23 - protein, 1172 aa, Arabidopsis thaliana
MVSGVGGSGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 24 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFFMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 25 - protein, 1156 aa, Glycine max
MLQQAERRIPPFRRRKSTPHEQRLSHHSSNNNNNIDSMSKAIAQYTEDGVHAVFEQSGESGRSFNYSESIRIASESVPEQQITAYLVKIQRGGFIQPFGSMIAVDEPSFRILGYSDNARDMLGITPQSVPSLDDKNDAAFALGPQSVPSLDDKNDAAFALGTDVRALFTHSSALLLEKAFSAREISLMNPIWIHSRTSGKPFYGILHRIDVGIVIDLEPARTEDPALSIAGAVQSQEALVRAISQLQSLPSADVKLLCDTVVESVRELTGYDRVMVYKFHEDEHGEVVSESKRPDLEPYIGLHYPATDIPQASRFLFKQNRVRMIVDCHASAVRVVQDEALVQPLCLVGSTLGAPHGCHAQYMANMGSIASLVMAVIINGNDEEGVGGRSSMRLWGLVVCHHTSARCIPFPLRYACEFLMQAFGLQLNMELQLAAQSLEKRVLRTQTLLCDMLLRDSPTGIVTQSPSIMDLVKCDGAALYFQGNYYPLGVTPTEAQIRDIIEWLLAFHGDSTGLSTDSLGDAGYPGLPRLGMQFVGWQVAYITEKDFLFWFRSHTAKEIKWGGAKLILRTRMMGQRMHPLSSFKAFLEVVKSRSLPWENAEMDAIHSLQLILRDSFKDAEHRNSKAVVDPHVSEQELQGVDELSSVAREMVRLIETATAPIFAVDVDGHVNGWNAKVSELTGLPVEEAMGKSLVHDLVFKESEETVNKLLSREEDKNVETKMRTFGKEHQNKAAFLVVNACSSKHFTNNVVGVCFVGQNVTGQKIVMHKFINIQGDYKAIVHSPNPLIPPIFASDDNTCCLEWNTAMEKLDPSNENVTVGGVDVIGKMLVGEVFGSCCQLKGSDSITKFMIVLHNALGGQDTDKFPFSFLDRHGKYVQTFLTANKRVNMEGQIIGAFCFLQIMSPELQQALKAQRQQEKEFLGRMKELAYICQGVKKPLSGIRFTNSLLEATSLTNEQKQFLETSVACEKQMLKIIRDVDLESIEDGSLELEKGEFLLGNVINAVVSQVILLLRERNLQLIRDIPEEIKTLAVYGDQLRIQQVLSDFLLNIVRYAPSPDGWVEIHVRPRIKQISDGLTLLHAEFRMVCPGEGLPPELIQDMFNNSRWGTQEGLGLSMSRKILKLMNGEVQYIREAERCYFYVLLELPVTRRSSKKC

SEQ ID NO: 26 - protein, 1131 aa, Lycospericum esculentum
MASGSRTKHSYHNSSQGQAQSSGTSNMNYKDSISKAIAQYTADARLHAVFEQSGESGKSFDYSQSVKTTTQSVPERQITAYLTKIQRGGHIQPFGCMIAVDEASFRIIAYSENACEMLSLTPQSVPSLDKSEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQRKYYPLGVTPTEAQIKDIVEWLLAYHGDSTGLSTDSLADAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHALGEMELQGIDELSSVAREMVRLIETATAPIFGVDVNGRINGWNEKVVELTGLSAEEAKGKSLVHDLLYKESQESAEKLLYNALRGVEGKNVEIKLRTFGAEQVEKAVFLVVNACSSRDYTNSIVGVSFVGQDVTGEKIVMDKFIHIQGDYKAIVHSPNPLIPPIFASDENTSCSEWNTAMEKLSGWSREEIVGKMLVGEIFGSCCRLKGPDAMTKFMIVLHNAIGGQDTDKFPFSFFDRNGKYVQALLTANKRVNMEGDTIGAFCFIQIASPELQQALRVQRQQEKKCYSQMKELAYICQEVKSPLNGIRFTNSLLEATNLTEYQKQYLETSAACERQMSKIIRDVDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGATVVHIELRIICPGEGLPPELVQDMFHSSRWVTQEGLGLSMCRKMLKLMNGEIQYIRESERCYFMIILDLPMTRKGPKSVG

SEQ ID NO: 27 - protein, 1121 aa, Lycospericum esculentum
MASGSGSRGKHDRNHQPKNQSQFSGTSNTNALSKAVAQYTTDARLHAAFEQSGESGKNFDYSQSVRNSTESVTEHQITAYLNKMQRGGHIQPFGCTIAVEEASFCVIAYSENACEMLDIMPQSVPSLEKNEILKIGTDVRTLFSSSSSGLLEGAFGAREITLLNPIWVHSKNSGKPFYAILHRIDVGIVIDLEPARTEDPALSIAGAVQSQKLAVRAISLLQSLPGGDIDLLCDTVVKSVRELTGYDRVMVYKFHDDEHGEVVAESRRSDLEPYIGLHYPATDIPQASRFLFKQNRVRMIVDCTAIPVRVIQDESLMQPLCLVGSTLRAPHGCHPQYMVNMGNVASLTLAVVINGNDDEVVGGRNAMRLWGLVVGHHSSARFIPFPLRYACEFLMQAFGLQLNMELQLASQLAEKRVLRTQTVLCDMLLRDSPTGIVTQNPSIVDLVKCDGAALYYQGRYYPLGITPTAAQIKGIVEWLLTCHVDSTGLSTDSLADAGYPEAASLGAAVCGMAVAYVTSKYFLFWFRSHTASEIKWGGAKHHPEDKDDWQKMHPRSSFKAFLEVVKNRSLPWENAEMDAIHSLQLILRDSFKDASNSKSIVRVQLREEGLQGMDELRSVAREMVRLVETATAPIFAVDVEGRINAWNAKVAELTELSVEEAIGKSLVHDLVHEESQTTAQNLLRKALRGEEDKNIEIKLRTFGAEQLKKTVFVEVNACSNKDYTNNIVGVSFIGQDITAQKVVLDKFVRIQGDYKAIMHSPNPLIPPIFVSDENTCCFEWNTAMEKLSGWNKEEIIGKMLVGEIFGTFCRLKGPDDMTNFMIMLHKAIGGQEIDKFPFSFSDRNGKFVQALLTANKRVNVDGQIIGAFCFLQIASPELQKTLMQRQQEKTSNIHMKELAYICRELKNPLNGIRFTNSLLEATELTENQKQFLETSAACERQMSKIIRDIDLDNIEDGSLELEKGEFFLASVIDAVVSQVMLLLRERGVQLIRDIPDEIKTLRVYGDQVRIQQVFADFLQIMASYAPPREGWVEVHLRPSIKQISDGVTIVHIEFRIVCPGEGLPPELIQDMFHNSLWVTQQGLGLSMCRRILQLMNGQVQYIRESERCFFLIILQLPMLIQ

SEQ ID NO: 28 - protein, 1135 aa, Nicotiana plumbaginifolia
MASGSRTKHSHQSGQGQGQVQAQSSGTSNVNYKDSISKAIAQYTADARLHAVFEQSGESGKSFDYSQSVKTTTQSVVPEQQITAYLTKIQRGGHIQPFGCMIAVDEASFGVIAYSENACEMLSLTPQSVPSLERPEILTVGTDVRTLFTPSSSVLLERAFGAREITLLNPIWIHSKNSGKPFYAILHRVDVGIVIDLEPAKTEDPALSIAGAVQSQKLAVRAISHLQSLPGGDVKILCDTVVESVRELTGYDRVMVYKFHEDEHGEVVAESKRPDLEPYIGLHYPATDIPQASRFLFKQNRVRMIVDCHATPVRVVQDESLMQPLCLVGSTLRAPHGCHAQYMANMGSIASLTLAVIINGNDEEAVGGRSSMRLWGLVVGHHTSARCIPFPLRYACEFLMQAFGLQLNMELQLASQLSEKHVLRTQTLLCDMLLRDSPTGIVTQSPSIMDLVKCDGAALYCQGKYYPLGVTPTEAQIKDIVEWLLTYHGDSTGLSTDSLADAGYPGAALLGDAVCGMAVAYITSKDFLFWFRSHTAKEIKWGGAKHHPEDKDDGQRMHPRSSFKAFLEVVKSRSLPWENAEMDAIHSLQLILRDSFKDAEASNSMAVVHAQLGEMELQGIDELSSVAREMVRLIETATAPIFAVDVDGRINGWNAKVAELTDLSVEEAMGKSLVHDLVHEESQETAENLLFNALRGEEDKNVEMKLRTFGSEQPKKAVFVVVNACSSKDYTNNIVGVCFVGQDVTGQKVVMDKFIHIQGDYKAIVHSPNPLIPPIFVSDENTCCSEWNTAMENLTGWSRGEIIGKMLVGETFGSCCRLKGPDAMTKFMIVLHNAIGGQDTDKFPFSFSDRNGKYVQALLTANKRVNMEGQIIGAFCFIQIASPELQQALRVQRQQDKKCYSQMKELAYLCQEIKSPLNGIRFTNSLLEATDLTEDQKQYLETSTACERQMSKIIRDVDLENIEDGSLTLDKEEFFLGSVIDAVVSQVMLLLRERSVQLIRDIPEEIKTLTVHGDQVRIQQVLADFLLNMVRYAPSPDGWVEIQLQPNMKQISDEVTVVHIEFRIVCPGEGLPPELVQDMFHSNRWVTKEGLGLSMCRKILKLMNGEIQYIRESERCYFLIILDLPMTGRGSKSVG

SEQ ID NO: 29 - protein, 1132 aa, Nicotiana plumbaginifolia
MASGSRTKHSHQSGQGQVQAQSSGTSNVNYKDSISKAIAQYTADARLHAVFEQSGESGKSFDYSQSIKTTTQSVVPEQQITAYLTKIQRGGHIQPFGCMIAVDEASFRVIAYSENACEMLSLTPQSVPSLERPEILTVGTDVRTLFTPSSSVLLERAFGAREITLLNPIWIHSKNSGKPFYAILHRVDVGIVIDLEPARTEDPALSIAGAVQSQKLAVRAISHLQSLPGGDVKLLCDTVVESVRELTGYDRVMVYKFHEDEHGEVVAESKIPDLEPYIGLHYPATDIPQASRFLFKQNRVRMIVDCHATPVRVVQDESLMQPLCLVGSTLRAPHGCHAQYMANMGSIASLTLAVIINGNDEEAVGGRSSMRLWGLVVGHHTSARCIPFPLRYACEFLMQAFGLQLNMELQLASQLSEKHVLRTQTLLCDMLLRDSPTGIVIQSPSIMDLVKCDGAALYCQGKYYPLGVTPTEAQIKDIVEWLLTYHGDSTGLSTDSLADAGYPGAALLGDAVCGMAVAYITSKDFLFWFRSHTAKEIKWGGAKHHPEDKDDGQRMHPRSSFKAFLEVVKSRSLPWENAEMDAIHSLLILRDSFKDAEASNSKAVVHAQLGEMELQGIDELSSVAREMVRLIETATAPIFAVDVEGRINGWNAKVAELTDLSVEEAMGKSLVHDLVHKESQETAEKLLFNALRGEEDKNVEIKLRTFGPEQLKKAVFVVVNACSSKDYTNNIVGVCFVGQDVTGQKVVMDKFIHIQGDYKAIVHSPNPLIPPIFASDENTCCSEWNTAMEKLTGWSRGEIIGKMLVGEIFGSCCRLKGPDAMTKFMIVLHNAIGVQDTDKFPFSFFDRNGKYVQALLTANKRVNMEGQIIGAFCFIQIASPELQQALRVQRQQEKKCYSQMKELAYLCQEIKSPLNGIRFTNSLLEATDLTENQKQYLETSAACERQMSKIIRDVDLENIEDGSLTLEKEEFFLGSVIDAVVSQVMLLLRERSVQLIRDIPEEIKTLTVHGDQVRIQQVLADFLLNMVRYAPSPDGWVEIQLQPNMKQISDEVTVVHIEFRIVCPGEGLPPELVQDMFHSSRWVTKEGLGLSMCRKILKLMNGDIQYIRESERCYFLIILDLPMTRRGSKSLG

SEQ ID NO: 30 - protein, 1171 aa, Oryza sativa
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSNPFYAILHRIDVGVVIDLEPARTEDPALSIAGAVQSQKLVVRAISRLQALPGGDVKLLCDTVVEHVRELTGYDRVMVYRFHEDEHGEVVAESRRSNLEPYIGLHYPATDIPQASRFLFRQNRVRMIADCHAAPVRVIQDPALTQPLCLVGSTLRSPHGCHGQYMANMGSIASLVMAVIISSGGDDDHNIARGSIPSAMKLWGLVVCHHTSPRCIPFPLRYACEFLMQAFGLQLNMELQLAHQLSEKHILRTGTLLCDMLLRDSPTGIVTQSPSIMDLVKCDGAALYYHGKYYPLGVTPTEVQIKDIIEWLTMCHGDSTGLSTDSLADAGYSGAADLGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSTRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFPFRFACPGEGLPPEIVQDMFSNSRWTTQEGIGLSICRKILKLMGGEVQYIRESERSFFHIVLELPQPQQAASRGTS

SEQ ID NO: 31 - protein, 1151 aa, Populus balsalmifera
MASQSQRQSNQRQHQNQAAQSSGTSNMRQHHHATESVSKAIAQYTVDAQLHAVFEQSGGSGKSFDYSQSVRTTSQSVPEEQITAYLSKIQRGGHIQPFGCMIAVDEGSFRVIAYSENAKEMLGLTPQSVPSLDKQEILSDGTDVRTLFRPSSSAMLEKAFGAREIILLNPIWIHSKNSGKPFYAILHRIDVGIVIDLEPARTEDPALSIAGAVQSQKLAVRSISQLQSLPGGDIKLLCDTVVESVRELTGYDRVMVYKFHEDEHGEVVAENKRADLEPYIGLHYPSTDIPQASRFLFKQNRVRMIVDCHATPVRVIQDEALMQPLCLVGSTLRAPHGCHAQYMANMGSIASLAMAVIINGNEEEAIGGRNSTRLWGLVVCHHTSARCIPFPLRYACEFLMQAFGLQLNMELQLASQLSEKHVLRTQTLLCDMLLRDSPTGIVTQSPSIMDLVKCDGAALYYQGQYYPLGVTPTEAQIKDIVEWLLALHGDSTGLSTDSLADAGYPGAASLGNAVCGMAVAYITKRDFLFWFRSHTAKEIKWGGAKHHPEDKDDGQRMHPRSSFKAFLEVVKSRSLLWENAEMDAIHSLQLILRDSFRDVEATNSKAVVHAQLEDTELQGMDELSSVAREMVRLIETATAPIFAVDVDGCINGWNAKVAELTGLSVDKAMGKSLVHDLVYKEYEETVDKLLHRALRGEEDKNVEIKLRTFGSEHQKKALFVVVNACSSKDYMNNIVGVCFVGQDVTGQKVVMDKYVHIQGDYKAIVHSPNPLIPPIFASDENTCCLEWNTAMEKFTGWSRGEVIGKMLVGEVFGSCCQLKGSDALTKFMIALHNAIGGQDTDKLPFSFFDRNGKYVQALLTANKRVNMEGEIVGAFCFLQIASNELQQALKVQRQQEKKCSARMKELAYICQEIRNPLSGLRFTNSLLENTDLTEDQKQFLETSAACEKQILKITRDVDLESIENGLLELEKAEFLFGSVINAVVSQAMLLLRERNLQLLRDIPEEIKTLVVYGDQARIQQVLADFLLNMVRYAPSSAGWVEIHVCPTLKQISDGHTLVHMEFKYALLNSFACLPPELVQDMFHSSRWVTQEGLGLSMCRKILKLMNGEVQYIRESERCYFLVILEVPMPNKCERYNCKKCCRLGCLVCNVY

SEQ ID NO: 32 - protein, 1146 aa, Populus balsalmifera
MASQSQRQSNQPVHNQAQSSGTSNMRQHHHATESVSKAIAQYTVDAQLHAVFEQSGGTGRSFDYSKSVRTTNQSVPEQQITAYLSKIQRGGHIQPFGCMIAADEQSFRVIAYSENAKDMLGLTPQSVPSLEKQEILFVGADVRILFRPSSAVLLEKAFGAREITLLNPIWIHSKNSGKPFYAILHRIDVGIVIDLEPARTEDPALSIAGAVQSQKLAVRAISQLQSLPGGDIKLLCDTVVDSVRELTGYDRVMVYKFHEDEHGEVVAENKRVDLEPYIGLHYPSTDIPQASRFLFKQNRVRMIVDCHAIPVRVIQDEALMQPLCLVGSTLRAPHGCHAQYMENMGSIASLAMAVIIYGNDEEAIGGRNSMRLWGLVVCHHTSARCIPFPLRYACEFLMQAFGLQLNMELQLASQLLEKHVLRTQTLLCDMLLRDSPTGIVTQSPSIMDLVKCDGAALYYQGQYYPLGVTPTETQIKDIVEWLLTLHGDPTGLSTDSLADAGYPGAAFLGDAVCGMAVAYIAERDFLFWFRSHTAKEVKWGGAKHHPEDKDDGQRMHPRSSFKAFLEVVKSRSLPWENAEMDAIHSLQLILRDSFRDAEATNSKAVVHTQLKDMELQGMDELSSVAREMVRLIETATAPIFAVDVDGRINGWNAKVAELTGLSVEEAMGKSLVHDLVYKEYEEIVDKLIHRAVKGEEDKNVEIKLRTFCSEHQKKAVFVVVNACSSKDYMDNIVGVCFVGQDITGQKVVMDKYVLIQGDYKAIVHSPNPSIPPIFASDENTCCLEWNTAMEKLTGWSRGEVVGKMLVGEVFGSCCRLKGPDALTKFMIALHNAIGGIDTDKLPFSFFDRNEKNVQTLLTANKRVNMEGDIIGAFCFLQIASPELQQTLKVQKQQEKKSFARMKELAYICQEIKNPLSGIHFTNSLLENTDLTEDQQQFLETSAACEKQILKIIRDIDLESIENGSLELEKAEFLLGSVINAVVSQAMLLLRERNLQLLRDIPEEIKTLAVYGDQARIQQVLADFLLNMVRYAPSSAGWVEIHVCPTLKQISDGHTLVHTEFKYLERVLQTRMLGLQHPLRSFLNFKLTLVMLHREGMVPKIQFQGLSVCQGRLIWLSYPENTTVTLYPLTIWFLLLYRRQSRSITHT

SEQ ID NO: 33 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEEQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFTYPGEGLPADIVQDMFSNSQWSTQEGVGLSTCRKILKLMGGEVQYIRESERSFFLIVLELPQPRPAADREIS

SEQ ID NO: 34 - protein, 1128 aa, Stellaria longipes
MESRNEGSRTNNNNNSNNPSDTMSRAIAQYTIDARLHAVFEQSGESGKSFDYSQSVKTYTSAESVPEQQITAYLSKIQRGGLIQPFGCMLAIDDLTYRIIAYSQNSVELLGFITTTTTTAVPSLEAVQQRIIAVGTDIRSLFMSSSCVLLEKAFSAREITLLNPVWIHSKANGKPFYAILHRIDVGIVIDLEPARTEDPALSIAGAVQSQKLAVRAISQLQSLPGGDVKLLCDTVVESVRQLAAYDRVMVYKFHEDEHGEVVAESKRADLEPYLGLHYPATDIPQASRFLFKQNRVRMIVDCHADSVSVVQDERLRQPLCLVGSTLRAPHGCHSQYMANMGSIASLVMAVIINGNDDEGSTRNAMRLWGLVVCHHTSPRSIPFPLRYACEFLMQAFGLQLNMELQLSAQVLEKRVLRTQTLLCDMILRESPTGIVTQSPSIMDLVKCDGAALLFCGKYYPLGVTPTELQLKDIVQWLLSNHGDSTGLSTDSLADAGYPGALALADAVCGMAVAFITRSDFLFWFRSHPAKEIKWGGAKHHPEDKDDVQRMNPRSSFKAFLEVVKSRSLPWENAEMDAIHSLQLILRDSFKDEETTHSKAIVHDQAGDVAMQGIDELSSVAKEMVRLIETAMAPIFAVDADGCINGWNAKASELIGLSVEEAMGKSLVHDLVCEDSKNVTQELLLHALQGDEDKNVEIKLKAFGSQQHKKAVYVVVNACCSKDYTNKIVGVCFVGHDVTGQKNVMDKFVNIQGDYKAIVHSPSPLIPPIFASDENSCCTEWNTAMEILTGYGKEDVIGKTLVGEIFGSICRLKGHDSLTKFMVVLHNAIGGQDSDKFPFSFYNRGGRYVQGLLTANKRTNIDGHITGAFCFLQIASSDLQQALEIQRQQENVCFERMKELAYLCQEIKNPLNGIRFANSLLEATSLGEDQKQFIETSNACEKQIKKILGDIHLESVDESPFELVKTEFMLGNIINAVVSQVMIPLRERELQLIRDIPEEIKTLAVCGDQIRIQQILAEFLVNMVRYAPSPDGWVEIHVLPRLKQVADGATVAYIEYRLVSPGEGLPPDLVQDMFHNSRWTTQEGLGLSMCRKILKLMNGEVQYIRESERSYFFVILELRMPPKQLMNVE

SEQ ID NO: 35 - protein, 1129 aa, Solanum tuberosum
MASGSRTKHSHHSSSQAQSSGTSNVNYKDSISKAIAQYTADARLHAVFEQSGESGKFFDYSQSVKTTTQSVPERQITAYLTKIQRGGHIQPFGCMIAVDEASFRVIAYSENACEMLSLTPQSVPSLEKCEILTIGTDVRTLFTPSSSVLLERAFGAREITLLNPIWIHSKNSGKPFYAILHRVDVGIVIDLEPARTEDPALSIAGAVQSQKLRSEGLFLICNHFLVGTLKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQGKYYPLGVTPTEAQIKDIVEWLLAYHGDSTGLSTDSLPDAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHAHLGEMELQGIDELSSVAREMVRLIETATAPIFAVDVEGRINGWNAKVAELTGVSVEEAMGKSLVHDLVYKESQETAEKLLYNALRGEEDKNVEIKLRTFGAEQLEKAVFVVVNACARDYTNNIVGVCFVGQDVTGEKVVMDKFINIQGDYKAIVHSPNPLIPPIFASDENTCCSEWNTAMEKLTGWSRGEIVGKMLVGEIFGSCCRLKGPDAMTKFMIVLHNAIGGQDTDKFPFSFFDRNGKYVQALLTRNKRVNMEGDTIGAFCFIQIASPELQQALRVQRQQEKKCYSQMKELAYICQEIKSPLNGIRFTNSLLEATNLTENQKQYLETSAACERQMSKIIRDIDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGVTVVHIELGLYAPGRLPPELVQDMFHSSRWVTQEGLGLSMCRKMLKLMNGEIQYIRESERCYFLIILDLPMTRKGPKSVG

SEQ ID NO: 36 - protein, 1130 aa, Solanum tuberosum
MASGSRTKHSHHSSSQAQSSGTSNVNYKDSISKAIAQYTADARLHAVFEQSGESGKFFDYSQSVKTTTQSVPERQITAYLTKIQRGGHIQPFGCMIAVDEASFRVIAYSENACEMLSLTPQSVPSLEKCEILTIGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQGKYYPLGVTPTEAQIKDIVEWLLAYHGDSTGLSTDSLPDAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHAHLGEMELQGIDELSSVAREMVRLIETATAPIFAVDVEGRINGWNAKVAELTGVSVEEAMGKSLVHDLVYKESQETAEKLLYNALRGEEDKNVEIKLRTFGAEQLEKAVFVVVNACASKDYTNNIVGVCFVGQDVTGEKVVMDKFINIQGDYKAIVHSPNPLIPPIFASDENTCCSEWNTAMEKLTGWSRGEIVGKMLVGEIFGSCCRLKGPDAMTKFMIVLHNAIGGQDTDKFPFSFFDRNGKYVQALLTANKRVNMEGDTIGAFCFIQIASPELQQALRVQRQQEKKCYSQMKELAYICQEIKSPLNGIRFTNSLLEATNLTENQKQYLETSAACERQMSKIIRDIDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGVTVVHIELRIICPGEGLPPELVQDMFHSSRWVTQEGLGLSMCRKMLKLMNGEIQYIRESERCYFLIILDLPMTRKGPKSVG

SEQ ID NO: 37 - protein, 1161 aa, Zea mays
MASGSRATPTRSPSSARPEAPRHAHHHHHSQSSGGSTSRAGGGAAATESVSKAVAQYTLDARLHAVFEQSGASGRSFDYSQSLRAPPTPSSEQQIAAYLSRIQRGGHIQPFGCTLAVADDSSFRLLAFSENSPDLLDLSPHHSVPSLDSSAPPHVSLGADARLLFSPSSAVLLERAFAAREISLLNPIWIHSRVSSKPFYAILHRIDVGVVIDLEPARTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIHSLQLILRDSFRDAAEGTNNSKAIVNGQVQLRELELRGINELSSVAREMVRLIETATVPIFAVDTDGCINGWNAKIAELTGLSVEEAMGKSLVNDLIFKESEATVEKLLSRALRGEEDKNVEIKLKTFGSEQSKGPIFVVVNACSSRDYTQNIVGVCFVGQDVTGQKVVMDKFVNIQGDYKAIVHNPNPLIPPIFASDENTSCSEWNTAMEKLTGWSRGEVVGKFLIGEVFGNCCRLKGPDALTKFMVIIHNAIGGQDYEKFPFSFFDKNGKYVQALLTANTRSKMDGKSIGAFCFLQIASTEIQQAFEIQRQQEKKCYARMKELAYICQEIKNPLSGIRFTNSLLQMTDLNDDQRQFLETSSACEKQMSKIVKDASLQSIEDGSLVLEQSEFSLGDVMNAVVSQAMLLLRERDLQLIRDIPDEIKDASAYGDQCRIQQVLADFLLSMVRSAPSENGWVEIQVRPNVKQNSDGTNTELFIFRFACPGEGLPADVVQDMFSNSQWSTQEGVGLSTCRKILKLMGGEVQYIRESERSFFLIVLEQPQPRPAAGREIV

SEQ ID NO: 38 - protein, 1166 aa, Zea mays
MASDSRPPKRSPSARRVAPRHAHHHHSQSSGGSTSRAGAGGGGGGAAATESVSKAVAQYNLDARLHAVFEQSGASGRSFDYSQSLRAPPTPSSEQQIAAYLSRIQRGGHIQPLGCTLAVADDSSFRLLAFSENAADLLDLSPHHSVPSLDSVALPPVSLGADARLYFSPSSAVLLERAFAAREISLLNPLWIHSRASSKPFYAILHRIDVGVVIDLEPARTEDPALSIAGAVQSQKLAVRAISRLQALPGGDVKLLCDTVVEHVRELTGYDRVMVYKFHEDEHGEVVAESRRDNLEPYLGLHYPATDIPQASRFLFQQNRVRMIADCHAIPVRVIQDPGLSQQLCLVGSTLRAPHGCHAQYMANMGSIASLVMAVIISSGGDDERTGRGAISSSMKLWGLVVCHHTSPRCIPFPLRYACEFLMQAFGLQLNMELQLAHQLSEKHILRTQTLLCDMLLRDSPAGIITQSPSVMDLVKCDGAALYYRGKYYPLGVTPTESQIKDIIEWLTVCHGDSTGLSTDSLADAGYLGAVALGDAVCGMAVAYITPSDYLFWFRSHTAKEIKWGGAKHHPEDKDDGQRMHPRSSFKAFLEVVKSRSLSWENAEMDAIHSLQLILRDSFRDAAEGTSNSKAIVNGQRQLGELELRGINELSSVAREMVRLIETATVPIFAVDTDGCINGWNAKIAELTGLSVEEAMGKSLVNDLIFKECDDIVEKLLSRALRGEEDKNVEIKLKTFGSEQSKGAIFVIVNACSSRDYTQNIVGVCFVGQDVTGQKVVMDKFINIQGDYKAIVHNPNPLLPPIFASDENTSCSEWNTAMEKLTGWSREEVVGKFLIGEVFGNCCRLKGPDALTKFMVVIHNAIEGHDSEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETSSACEKQMSKIVKDASLKSIEDGSLVLEKSEFSLGDVMNAVVSQTMSLLRERDLQLIRDIPDEIKDASAYGDQFRIQQVLADFLLSMAQSAPSENGWVEIQVRPNVKQNYDGTDTELFIFRFACPGEGLPADIVQDMFSNSQWSTQEGVGLSTCRKILKLMGGEVQYIRESERSFFLIVLELPQPRLAAGRENQLIC

SEQ ID NO: 39 - protein, 1111 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIEKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVELEFRIIHPAPGLPEDLVREMFQPLRKGTSREGLGLHITQKLVKLMERGTLRYLRESEMSAFVILTEFPLI

SEQ ID NO: 40 - protein, 1137 aa, Oryza sativa
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACTLQFTQPAEGPIVLQVIPRMENIGSGMQIAHLEFRLVHPAPGVPEALIQEMFRHSPGASREGLGLYISQKLVKTMSGTVQYLREAESSSFIVLVEFPVAQLSTKRCKASTSKF

SEQ ID NO: 41 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLWDMLLRDAPVGIFTQSPNVMDLVKCDGVALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 42 - protein, 1114 aa, Sorghum bicolor
MSSSTSRNSSVRSRHDAHVVIQTPVDAQLASDFEQSERVFNYTSSVDLNLLASSSDVPSSTVKSYLQKVQRGGLIQSFGCLIAIDEKNFKVIAYSENAPEMLDLTPHTVPNIEQLEALTFGTDVATLFTSSGVSALQKAVNYSELNLLNPILVHSKNSGKPFYAILHRIKVGLVLDLETVNLAETLVGVSGALMSYKLAAKAISKLQSLPSQNIPLLCDVLVKEVRELTGYDRVMVYKFHDDQHGEVIGESHSPSLDSYLGLHYPATDIPQASRFLFLKNKVRMICDCRSPSVKVIQDEALTQPLSLGGSTLRAPHGCHAQYMANMGSIASLVMAVTINNEEDEVSDRHRTRKLWGLVVCHHTSSRFVPYPLRYACEFLVQVFGIHINKEVELAAQVREKHILKIQSMLCDMLMRDSPITIITQSPNVMDLVKCDGAALLYQSKLWVLGITPKSNQIKDISQWLFEYHGNTKGLITDSLKEAGYPGALELGDAVCGMAAVRISSEEMLFWFRSHTAKEIKWGGAKHEPGQNDERGIMHPRSSFNAFLDVVKWRSVPWEDMEMDSIYSLQLIFIKCLVKNKTMSDTSKMIVNVPGVGVGGPLSSALKVEPLTGEVIRLIETAAVPIFSVDVTGAINGWNFKVAELTGVPMEQVIGSQLVDVVVEGTVEVLKNILSSALQGTEEKNVEIRLRTLGSHGKTSYVVLVVNACCSRDVDENVTGICFVGQDVTEEKRIVDQITELQGDYSGIMRNPCHLIPPIFLIDDQGVGLEWNDAMAKISGLSKEYTVGRMLIGEVFTNGNDGCQVKDYETLLRLKIFLSKMIDGEESDKVLFGFFDHRKKCIDALLCATPRFNADRNITGVLCFLHLPSPELQYSIHMQKVSEKAATSTLKKLTYFREQVRSPIKGMAFTRNLLESSELNIEQKQILTTISLCESQLMKIIEDTDIPSIEEGYLETSSDDFNLLEALDAVVSQVMPLSQESQVHIKHDFPSDLSPVCLFGDNVRLQQILSNFLTIAVRFTPPSTGSSVKFAVSSRTEHVGSKMQMFHVEFRITHPLPGVPENLIREMFQRSPGMSRGGLSLYISHKLVKIMNGTLQYLRGEDYSSFIVFLEFPVA

SEQ ID NO: 43 - protein, 1139 aa, Triticum aestivum
MSSSRSNNRPACSRGSSARSKHSERVVAQTPVDARLHAEFEGSQRHFDYSSSVSALNRSGASTSSAVSAYIQNMQRGRYIQPFGCLLAIHPESFALLAYSENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTGLTLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLVIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 44 - protein, 1135 aa, Zea mays
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSVALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFYEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPTELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 45 - protein, 1135 aa, Zea mays
MSSPSNNRGTCSRSSSARSKHSARVVAQTPVDAQLHADFEGSQRHFDYSSSVGAANRPSASTSTVSTYLQNMQRGRYIQPFGCLLAVHPDTFALLAYSENAPEMLDLTPHAVPTIDQRDALTIGADVRTLFRSQSSVALHKAATFGEVNLLNPILVHARTSGKPFYAILHRIDVGLVIDLEPFNPADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKMRMICDFSATPVLIIQDGSLAQPVSLCGSTLRASHGCHAQYMANMGSVASLVMSVTINDDEEEDGDTDSDQQPKGRKLWGLVVCHHTSPRFVPFPLRYACEFLLQVFGIQLSKEVELAAQAKERHILRTQTLLCDMLLRDALVGIFTQSPNVMDLVKCDGAALYYQNQVLVLGSTPSESEIKSIATWLQENHDGSTGLSTDSLVEAGYPGAAALREVVCGMVAIKISSKNFIFWFRSHTTKEIKWSGAKHEPFDADDNGRKMHPRSSFKAFLEVVKWRSVPWEDVEMDAIHSLQLILRDSLQGEDANRNNIRSIVKAPSDDMKKLQGLLELRTVTNEMVRLIETATAPVLAVDIAGNINGWNKKAAELTGLPVMEAIGRPLIDLVVADSVEVVKQILDSALQGIEEQNLEIKLKTFHEQECCGPVILMINSCCSRDLSEKVIGVCFVAQDLTRQKMIMDKYTRIQGDYVAIIKNPSELIPPIFMINDLGSCLEWNKAMQKITGMKREDAINKLLIGEVFTLHDYGCRVKDHATLTKLSILMNAVISGQDPEKLLFGFFGTGGKYIESLLTVNKRTNAEGKITGALCFLHVASPELQHALEVQKMSEQAATNSFKELTYIRQELRNPLNGMQFTYNLLKPSELTEDQRQLVSSNVLCQDQLKKILHDTDLESIEQCYMETNTVEFNLEEALNTVLMQGIPLGKEKRISIERDWPVEVSHMYIYGDNIRLQQVLADYLACALQFTQPAEGHIVLQVIPKKENIGSGMQIAHLEFRIVHPAPGVPEALIQEMFQHNPGVSREGLGLYISQKLVKTMSGTLQYLREADTSSFIILIEFPVAQLSSKRSKPSPSKF

SEQ ID NO: 46 - protein, 1137 aa, Lycospericum esculentum
MESQSSENRRGGGGRTSLNQNKQNNNKDSGLNTSSAASNMKNNASKAALAQYNADAKLMAEFEQSSVSGKSFDYSKSVLFPPHEANEEEITSYLSRIQRGGLVQPFGCMVAIEEPTFKIIGYSENCYDMLGFKPTKMKLGLIGVDARNLFTPSSGDSLAKVMASREISLLNPIWVHSRTTHKPFYAILHRIDVGIVIDLEPANSSDPALLLAGAVQSQKLAVRSISRLQSLPGGDIGVLCDTAVEDVQKLTGYDRVMVYKFHDDNHGEIVSEIRRSDLEPYLGLHYPATDIPQAARFLFKQNRVRMICDCNAQPVKVVQSEELKQPICLVNSTLRSPHECHSKYMANMGSISSLVMAILINSGDSMKLWGLIVCHHTSPRYVPFPLRYACEFFTQAFGLQLNMELQLASQLAEKKTLQMQTLLCDMLLRDVPFGVVTQSPSIMDLVKCDGAALYCGGKCWLLGVTPTEAQVKDIAQWLLVAHKDSTGLSTDCLADAGYPGAALLGDAVCGMATARITSKDFLFWFRSHTAKEVKWGGAKHHPDDKDDGGKMHPRSSFNAFLEVVKSRSLPWEIPEINAIHSLQIIMRESIQENENSSLKTLTTSQQNDADGPSMDELSSVAMEMVRLIETATAPIFGVDPSGLINGWNEKIADLTGLHASEAVGMSLINDITHEDSRGTVEKVLHRALLGEEEKNVEIKLRRFGKDPPGSVIYLVINACTSRDHKNGVVGVSFVAQDVTPEKFIMDKFIQLRGDYEAIVQSLSPLIPPIFASDENACCSEWNAAMERLTGWTKYEVMGRTLPGEVFGGLCRLTGQDALTKFMILFYQAISGHDTKKLPFGFFNRRGEFLEVFLTANKRTDEHGNVCGCFCFLQPMTIDPEASDERQDSKDSLWKYKEYVYVLQQMKNPLNGIQFTHKLLEATGVSDNQKQLLETSEACEKQILSVIDNMDFGGIEDGKVQLNMEEFVLGNVVDAIVSQVMIFLKEKNLQLLHDIPDQIKTLPLYGDQIKLQRVLSDFLLSVVHHAPSPDGWVEIKVLPGLKLIQDGNELIHLQLRMTHPGQGLPAALIDDMSGERNRWTTQEGIALNVAQKLLNVMNGHVRYVRGEDKCYFLIDVELQTLKPTQHGPKLEVTQEIEI

SEQ ID NO: 47 - protein, 1112 aa, Arabidopsis thaliana
MGFESSSSAASNMKPQPQKSNTAQYSVDAALFADFAQSIYTGKSFNYSKSVISPPNHVPDEHITAYLSNIQRGGLVQPFGCLIAVEEPSFRILGLSDNSSDFLGLLSLPSTSHSGEFDKVKGLIGIDARTLFTPSSGASLSKAASFTEISLLNPVLVHSRTTQKPFYAILHRIDAGIVMDLEPAKSGDPALTLAGAVQSQKLAVRAISRLQSLPGGDIGALCDTVVEDVQRLTGYDRVMVYQFHEDDHGEVVSEIRRSDLEPYLGLHYPATDIPQAARFLFKQNRVRMICDCNATPVKVVQSEELKRPLCLVNSTLRAPHGCHTQYMANMGSVASLALAIVVKGKDSSKLWGLVVGHHCSPRYVPFPLRYACEFLMQAFGLQLQMELQLASQLAEKKAMRTQTLLCDMLLRDTVSAIVTQSPGIMDLVKCDGAALYYKGKCWLVGVTPNESQVKDLVNWLVENHGDDSTGLTTDSLVDAGYPGAISLGDAVCGVAAAEFSSKDYLLWFRSNTASAIKWGGAKHHPKDKDDAGRMHPRSSFTAFLEVAKSRSLPWEISEIDAIHSLRLIMRESFTSSRPVLSGNGVARDANELTSFVCEMVRVIETATAPIFGVDSSGCINGWNKKTAEMTGLLASEAMGKSLADEIVQEESRAALESLLCKALQGEEEKSVMLKLRKFGQNNHPDYSSDVCVLVNSCTSRDYTENIIGVCFVGQDITSEKAITDRFIRLQGDYKTIVQSLNPLIPPIFASDENACCSEWNAAMEKLTGWSKHEVIGKMLPGEVFGVFCKVKCQDSLTKFLISLYQGIAGDNVPESSLVEFFNKEGKYIEASLTANKSTNIEGKVIRCFFFLQIINKESGLSCPELKESAQSLNELTYVRQEIKNPLNGIRFAHKLLESSEISASQRQFLETSDACEKQITTIIESTDLKSIEEGKLQLETEEFRLENILDTIISQVMIILRERNSQLRVEVAEEIKTLPLNGDRVKLQLILADLLRNIVNHAPFPNSWVGISISPGQELSRDNGRYIHLQFRMIHPGKGLPSEMLSDMFETRDGWVTPDGLGLKLSRKLLEQMNGRVSYVREDERCFFQVDLQVKTMLGVESRGTEGSSSIK

SEQ ID NO: 48 - protein, 1115 aa, Ipomoea nil
MENYGKAVTFSSSATSNLNTGKAIAQYNADAKLMAEFEQSRESGKSFDYSRSVIHAPQNVTEEEMTAYLSRIQRGGLIQPFGCMLAIEEPSFKIVGFSENCFDLLGLKSGVEPPERMSLIGIDARTLFTLSSRASLAKAVASREISLLNPIWVHSKINQKPFYAVLHRIDVGIVIDLEPANSADPALLLAGAVQSQKLAVRAISRLQSLPGGDIGTLCDTVVEDVQKLTGYDRVMVYKFHDDSHGEVVSEIRRSDLEPYLGLHYPATDIPQAARFLFKQNRVRMICDCNAQPVKVLQCEELKQPLCLVNSTLRSPHGCHTKYMANMGSIASLVMAVVINSSESMKLWGLVVCHHTSPRYVPFPLRYACEFLMQAFSLQLYMELQLASQLAEKKILQTQTLLCDMLLRDAPFGIVTQTPSIMDLVRCDGAALYYNGKCWLLGVTPTETQVKDIAEWLLHNHGDSTGLSTDCLSDAGYPGAPLLGDAVSGMATARITSKDFLFWFRSHTAKEVKWGGAKHHPEDKDDGGRMHPRSSFIAFLEVVKSRSLPWEDSEINAIHSLQLIMRDSLQGIGENYMKSVSSPQQNDSDGVRFYELSSMALELVRLVETATVPIFGVDSSGLINGWNAKIAELTGLQANVAIGKYLIDDVTHEDSHETFKALMCRALQGEEDRNVEVKLLKFGNHPTKEVVYLVVNACTSRDYKNDIIGVCFVGQDITPEKAVMDKFVRLQGDYEAIIQSLNPLIPPIFASDENACCSEWNAAMERLTGLVKCEVIGKRLPGEIFGGLCRLKGQDALTKFMILLYQGISGHDTEKLSFGFFDRKGNFIDVFITANKRTDERGNIIGCFCFLQTMAVDHPQISARDIEDDRECLSTLKEFAYIQQQMKNPLNGIRFTHKLLEGTVTSDHQKQFLETSEACEKQILSIIENMDSGGIVDGNRVELKTEEFVIGNVIDAVVSQVMIPLKEKNLQLLHDIPDQIKSLPIYGDQIKLQLVLSDFLLSIVRHAPSPDGWVEIRVSPGLKLIQDGNVFIHIQFRMTHPGQGLPSALIEDMVRGGTRWTTQEGVVLHLSQKLVRMMNGHVHYVREQQKCYFLIDLDFKTQKPRSRESSMDTKAD

SEQ ID NO: 49 - protein, 1118 aa, Lycospericum esculentum
MSSSSTTNKTNCSRGSSARSRRSARVIAQTPVDAKLHVEFEESEQQFDYSSSVNLSNSTSNVPSSTVSDYLQKMQRGSLIQPFGCMIAIDAQNFAVIAYSENAPEMLDLTPHAVPSIEQQEALTFGTDVRKLFRSSGASALEKAVSFGELSLLNPILVHCKNSGKPFYAILHRIEVGLVIDLEPVDPHEVPVTTAGAIKSYKLAAKAIRKLQSLPSGDISLLCDVLVREVSHLTGYDRVMVYKFHEDEHGEVVAECRTPELEPYLGLHYPATDIPQASRFLFMKNKVRMICDCLAPPIRVIQDPRLAQSLSLGGSTLRAPHGCHAQYMTNMGTVASMAMSVMINEQDDELDSDQQVGRKLWGLVVCHHTCPRFLSFPLRYASEFLLQVFSVQVNKEVEMAAQLKEKQILQIQTVLCDMLLRDAPMGIVTQSPNVMDLVKCDGAALYYRNKLWLHGVTPAESQIRDIAEWLNESHGDSTGLNTDSLMEAGFPGASVLGDAVCGMAAVKITSKDFLFWFRSHTAKEIKWGGAKHLPGDKDDGRKMHPRSSFKAFLEVVKRRSLPWEDVEMDAIHSLQLILRGSLQDEAADCSKMIVNVPAVDTIIDRVDTLHINDMVRLVETASMPVLAVDTSGRINGWNSKVSELTGLPVENVIGVPLVDLVIGGTTNTIKRVLSLALQGKEEKNVEIKLRTLGPQEKVGSISIVVNACCSRDFKQNIVGVCFTGKDVTGLKLIKDKYSRVQGDYVGIIHSPSPLIPPIFVMDEQGRCVEWNDAMHKLTGSKREEVIDQMLLGEVFTVNSFGCRVKDQDTLTQLTILLNRVIAGGEGEKLFFGLFNKQDKYIEALISANKKVDDDGRVTGVLCFLHVPSPELQYAMHVQKLSEQAAKNSLKKLAYVRLELKNPLNGINCIQNLLKSSDLSKDQRQLLKTSTMCQKQLAKIIDDTDIESIEECYTEMNSCEFNLGEVVTVVINQVMILSQERKVQVTWDSPVEVSQLYLIGDNLRLQQVLSDFLTTAILFTPFEDSSVHFRVIPRKERIGTKMYIMHLEFRITHPSPGIPDDLIQHMFHYSRSISREGFGLYISQKLVKIMDGTVQYLREADRSSFIILVEFPLMEKKNN

SEQ ID NO: 50 - protein, 1117 aa, Adiantum capillus
MSSTRHSYSSGGSGKSKHGRRIAQTSANAKLYAAYEESSESGSFDYSQSVSAGKEGISSQLVTAYLQRMQRGGLVQQFGCLIAVEEETFRVLHMCEAPEMLDVATQAVPTMGQYSRLCIGADVRTLLSPASASALDRVIGVVDVSMFNPITVQSRSSGKPFYAILHRNDVGLVIDLEPIRPDDASITGGALQSHKLAAKAIARLQSLPGGDIGLLCDSVVEEVHELTGFDRVMAYKFHEDEHGEVVAEIRRTDLEPYIGLHYPATDIPQAARFLFMKNRYKMICDCRLPPVKLIQDKTLSQPMSLTGSTLRAPHGCHTQYMANMNSISSLVKAVIVNDSDDDSAGHSSQGIKLWGLVVCHHTSPRYVPFPVRSACEFLMQVFSLQLNMEVGMAAQVREKRILRTQTLLCDMLLRDAPIGIVSQSPNIMDLVTCDGAALYYGKKCWLLGTTPTEAQIVDIAAWLLDCHKDSTGLSTDSLAKTGYPEASCLGDAVCGLAAAKITATDFLFWFRSHTAKEVRWGGARHDPEERDDGRRMHPRSSFKAFLEVVKQQSLFWEDVEMDAIHSLQLILRGSFQDIDDSNTKTMIHARLNDLKLQGLDELSTVASEMVRLIETATAPILAVDGQGLINGWNGKVAELTGLCFETAMGKSLAKELVREESKTIVERVLRLALEGEEEQDIEIHLRTYDQHKQKGVVILIVNTCCSRDVSNNVVGVCFVGQDVTGQKLVLDRFIRIQGDYKAIVQSLNPLIPPIFGADEYGFCSEWNAAMEKLSNWRREEVLGKMLVGEIFGLQMVCCRLQGQDVVTKLMIVLNDAVNGQESEKFPLVFYDRNGRRVEALLIASKRTDADGRITGVFCFLHTASPELLQALIIKRAKEKVDKELSYVKEELKKPLEGLAFTRTVLEGTNLTIEQRQLIKTNAWCERQLRKILEDDLNNIEEGYMDLEMSEFFMGSVIDAVISQGMAASRGKGVQILTDIPNDVKLMCDFGDQARLQQVLADLLFCAINHATTTNEDEKDWVTIKVSRTKTRLDDGVHLMHFESRISHSGQGISEALVEEMTNKSQKWTPEGLAISISCTLIRLMNGDVKYTTDAGNKCFLVTIQFPLAHRDDATSVR

SEQ ID NO: 51 - protein, 1140 aa, Adiantum capillus
MSSKTMTYSSSAAEPRSSSSSVVGSKHNRRVVVAQTTADAKLHAVFEQAQSEGDTGGSSFDYMRSIEDARGSVLSERVPAQAVTAYLQRMQRGGLIQPFGCMLALEEGSFRVIAYSENAAEMLDLMPQSVPSVGVQVLVLGIGTDARTLFTYASAAALEKASGAVDVSMLNPITVHCRSSSKPFNAIVHRIDVGLVIDFEPVRPADVAVWAAAGALQSHKLAAKAISRLQALPVGDIDLLCDSVVEEVRELTGYDRVMAYKFHEDEHGEVLAEIRRSDLEPYLGLHYPATDIPQASRFLFMKNRVRMICDCRALPVRVIQDKELRQPLSLAGSTLRAPHGCHSQYMANMGSIASLVMAVVVNDNDEDVSNRSQQPKMRRLWGLVVCHHTTPRAVPFALRSACEFLMQVFGLQLNMELELAAQMREKHILRTQTLLCDMLLRDAPIGIVSESPNIMDLVKCDGAALYYGKNFWLLGTTPIEAQIKDLAEWLLDVHRDSTGLSTDSLADAGYPGAAALGDAVCGMAAAKITTRDFLFWFRSHTAKEIKWGGAKHDPEDRDDGRKMHPRSSFKAFLEVVKRRSLPWEDMEMDAIHSLQLILRGSFQDIDDSDTKTMIHARLNDLKLHGMDELSTVANEMVRLIETATAPIFAVDAGGFINGWNAKVAELTGLTVEEAMSRSLVRDVVVNASMETAERVLDLALQGQEEQNVEIKLKTYGDQAIKGPVILIVNACSSRDFTDNVVGVCFVGQDVTGQKVVMDKFTRIQGDYKTIVQNPNPLIPPIFGADEFGYCSEWNPAMEKFSGWKREDVIGKMLIGEVFGSDLACCKLRGQDSMTKFMIILNAAMGGRDSDRFPFGFFDRYGKYAEALLIANKRTDSDGAITGVFCFLHTASPELQQALQVQKRSARTALDRLKEVAYMKQEIRNPLYGIVFTRKLLDNTNLTDEQKQIMETSSLCEKQLQNILDEDNFEKLDQGNVDLDTLEFTMGTVMDAVISQGMIRSREKGLQLIRETHVEIKNTRLFGDQYRLQQVLADFLTTAIRFTSSSDGWVGIKVVPTIKNMKDGLHIVHFEFRVSHPGSGIPEDLVQQMYDRSQEITQEGMGLSVSRKLVKLMNGDVKYTREAGVCYFLVTVELPLVQEDD

SEQ ID NO: 52 - protein, 1465 aa, Adiantum capillus
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 53 - protein, 1129 aa, Adiantum pedatum
MSTSKAATYNSSAGSSVRSKQNRRAVVQTTVDANVHAVFEQSGDTGNSFDYTRSIDASRSSSESIPPQAVTAYLQRMQRGGLIQPFGCMLAVEEESFRVIAFSENALEMLDLMSQAVPSVGMQEILGIGSDARSYFTPSSAAALEKAVGAVDVSMLNPITIHSKGSGKPFNAVVHRIDVGLVIDFEPLRQADITVSAAGALQSHKLAAKAISRLQALPVGDIGLLCDSVVEEVRELTGYDRVMAYKFHEDEHGEVVAEIRRSDLAPYLGLHYPATDIPQASRFLFMKNRVRMICNCAATPVRVIQDKGLRQPLSLAGSTLRAPHDCHSQYMANMGTIASLVMAVIVNDNDEEVSNRTHQPKQRKLWGLVVCHHTTPRAVPFPLRSACEFLMQVFGLQLNMEVELAAQMREKHILRTQTLLCDMLLRDAPIGIVSESPNIMDLVKCDGASLYYGKKFWLLGTTPTEAQIKDLADWLLEVHKDSTGLSTDSLADAGYPGATALGDAVCGMAVAKITPRDFLFWFRSHTAKEVKWGGAKHDPDDRDDGRKMHPRSSFKAFLEVVKRRSSPWEDVEMDAIHSLQLILRGSFQDIDDSDTKTMIHARLNDLKLQGMDELSTVANEMVRLIETATAPIFAVDASGCINGWNAKVAELTGLPVEEAMNRSLIRDLVVDEAVESVERLLYLALQGEEEQNVEIKLKTYGDQAEKGPVILVVNACSSRDFTENVVGVCFVGQDVTGQKVVMDKFTRIQGDYKTIVQSPNPLIPPIFGADEFGFCSEWNPAMEKLSGWKREDVLGKMLVGEVFGTELTCCRLRGQDAMTKFMIVLNTAMGGKDWDRFPFAFFDHDGKYVEALLTANKRTVGDGAITGVFCFLYTASPELQQALQVHKRSARTALERLKEVAYMKQEIRNPLYGIIFTRKLMESSNLTAEQKQLIETSAVCERQLQKILDEDNFEKLDQGNIDLETVEFSMGTVMDAVISQGMIRSREKGLQLVRETNIELKNTPVFGDQLRLQQVLADFLTTAVRFTSSSDGWVGIKVVSSIKSIGDGFHVAHFEFRVTHPGSGIPEDLVQQMYDRSHEITQEGMGLSVSRKLVKLMNGEVSYIRDAGLCYFWSMLELPVVQSGKQAMF

SEQ ID NO: 54 - protein, 1121 aa, Ceratodon purpureus
MSAPKKTYSSTTSAKSKHSVRVAQTTADAALEAVYEMSGDSGDSFDYSKSVGQSAESVPAGAVTAYLQRMQRGGLIQTFGCMVAVEEPNFCVIAYSENASEFLDLMPQAVPSMGEMDVLGIGTDIRTLFTPSSGAALEKAAATQDISLLNPITVHCRRSGKPLYAIAHRIDIGIVIDFEAVKMNDVSVSAAGALQSHKLAAKAITRLQALPGGDIGLLCDTVVEEVRELTGYDRVMAYKFHEDEHGEVVAEIRRMDLEPYLGLHYPATDIPQASRFLFMKNRVRVIADCCASPVKLIQDPDIKQPVSLAGSTLRAPHGCHAQYMGNMGSIASLVMAVIINDNEEDSRGAIQRGRKLWGLVVCHHTSPRTVPFPLRSACEFLMQVFGMQLNMEVELAAQLREKHILRTQTLLCDMLLRDAPIGIVSQTPNIMDLVKCDGAALYYGKRFWLLGTTPTENQIKDIAEWLLEYHKDSTGLSTDSLADANYPGAHLLGDAVCGMAAAKITAKDFLFWFRSHTAKEVKWGGAKHDPAEKDDGRKMHPRSSFKAFLEVVKRRSLPWEDVEMDAIHSLQLILRGSFQDIDDSDTKTMIHARLNDLKLHGMDELSVVANEMVRLIETATAPILAVDSTGMINGWNAKIAHVTGLPVSEAMGRSLVKDLVLDESVVVVERLLYLASQGEEEQNVEIKLKTFGTQTEKEAVILIVNACSSRDVSDSVVGVCFVGQDVTGQKMFMDKFTRIQGDYKTIVKNPHPLIPPIFGGDEYGYCFEWNPAMEALTGWKHDEVVGKLLVGEIFGMEMMCCRLKSQDSMTKFMISLNNAMDGTNTDKFSFSFCNREGKFVEALLSTNKRTNADGVITGVFCFLQIASSELQQALTVQRATEKVAIAKLKELAYIRQEIKNPLCGITFTRQLLEDTDLSDDQKQFLDTSAVCEQQLQKVLNDMDLESIEDGYLELDTAEFEMGTVMDAVISQGMTTSREKGLQIIRETPREISTMRLFGDQIRLQQVLSDFLINAIRFTPSSEGWVKIKVVPTRKRLGGNVHVMHLEFRVSHPGGGLPDELVLEMYDRAKGMTQEGLGLNMCRKLVRLMNGDVQYVRENAQCYFVVYVELPMAQRDDAASQM

SEQ ID NO: 55 - protein, 1142 aa, Mesotaenium caldariorum
MSTSRMSQSSGESTAKTKREVRVAQATADAKLNTAFEASAAVGGSFDYTKSVGASLNAGSEAIPSSAVTAYLQRMQRGGITQTFGCMLMVEEGSFRVRAFSENAGEMLDLVPQAVPSMGQQSLIAVGTDIRTLFTSASVSLLEKAAMATDVSVMNPVSLQSRAAKKPFFAVLHRIDVGLVVDLEPVRPSDPNVSAAGAMQSHKLAAKAISRLQSLPGGDIGLLCDAVVEEVRELTGYDRVMAYKFHEDEHGEVIAEIRRSDLEPYLGLHYPATDIPQAARFLFMKNRVRIICDCSAPPVKVIQDPTMKHPISLAGSTLRGVHGCHAQYMANMGSVASLVMAVIINDNSSEEGATAAGGILHKGRKLWGLVVCHHSSPRYVPFPLRSACEFLMQVFGLQLNMEVELSSQLREKHILRTQTLLCDMLLRDAPMGIVSQSPNITDLVKCDGAALFYHGRAWLLGVTPSEAQVRDIAAWLLDSHKDSTGLSTDSLADAGYPNADSLGVSVCGMAAARITSKDFLFWFRSHAQKEVKWAGAKQEPGDRDREEGEEGGRMHPRSSFQAFLEVVKQRSLPWEDVEMDAIHSLQLILRGSFQDMEGEGGGSQQGNKRMINARLNDLKLQGMDELSTVANEMVRLIETATAPILAVDSLGCVNGWNAKVSELTGLPVSEAMGKSLVKDLVQRESREAVERVLYMALNGEEEQNVEIQLKTWGPQLHSHGGTVILVVNACASRDVSESVVGVCFVGQDVTGEKEVLDKFIRIQGDYTTIVRSRNSLIPPIFGSDEYGCCTEWNPAMEKLTGVRREDVIGRMLMGDVFGSALRLRGSDGLTQFMIVLNRAMDGADTDKFPFTFYDREGKCVDSLLTANKRTDADGAITGVFCFLHTVSLELQQALSVQKAAERVAEAKAKELAYIRQEIQNPLDGIHFARSFIEHTELSEDQKQLMETSATCEKQLRRILDDMDLESIEEGYLELETGEFMMATVMNSVVSQGMVQSSKKGLQLFCDTPPEFKSMCVFGDQVRLQQVLADFLMNAVQFTPASGWVEIKVVPNVRSLPGGITMAHMEFRVTHSGEGLPEDLVHQMFDRADAHSKSQEGLGLSMCRKIVRLMSGEVRYVREPGKSYFLVLLDLPLAQREDAGSAM

SEQ ID NO: 56 - protein, 1126 aa, Marchantia paleacea
MSTTKVTYSSGSSAKSKHSVRIVQTTADAKLQAVFEESGESGDSFDYTKSINASKSTGESVPAQAVTAYLQRMQRGGLTQTFGCMLAVEELTFRVLAYSENAPEMLDLMPQAVPCVGQQDVLGIGTDARTLFNSASAVALEKAAGALDVSMFNPISVQCKSSGKPFYAIVHRIDAGLVIDIEPVRPSDPSVSAAGALQSHKLAAKAISRLQSLPGGDIGLLCDTVVEEVRELTGYDRVMAYKFHEDEHGEVVAEIRRSDLEPYLGLHYPATDIPQASRFLFMKNRVRMICDCCAQPVQVIQDKELRQPLSLAGSTLRAPHGCHAQYMGNMGSIASLVMAVIINVNDEEYSSRGYHHKGRKLWGLVVCHHTTPRSVPFPLRSACEFLMQVFGLQLNMEVELAAQLREKRILRTQTLLCDMLLRDAPIGIVSQSPNIMDLVKCDGAALYYGKRYWVLGTTPTELQIKDIADWLLEYHKDSTGLSTDSLADAGYPGAASLGDAVCGMAAARITSKDFLFWFRSHTAKEIKWGGAKHDPDDKDDGRKMHPRSSFKAFLEVVKRRSLPWEDVEMDAIHSLQLILRGSFQDIDDSDTKTMIHARLNDLKLQGMDELSTVANEMVRLIETATAPILAVDSSGFINGWNAKVAELTGLPVSEAMGRSLVKDLALEESVETVERLLYLALQGEEEQNVEIKLQTYGAQKDKGAVILIVNACSSRDVTENVVGVCFVGQDVTGQKVVMDKFTRIQGDYKAIVQNPNPLIPPIFGSDEFGYCSEWNPAMEKLAGWKREEVIGKMLVGEIFGTQMMCCRLKGQDAMTKFMIVLNSAMDGQDSEKFPFAFFDRQGKFVEALLTANKRTDSEGAFTGVFCFLQIASMELLQALTVQRATEKVAFSKLKELAYIRQEIKNPLYGIMFTRNLVEDTNLTEEQKQFIETSALCERQLRRILDDMDLESIEDGYLELDTAEFIMGTVMDAVISQGMITSREKGLQLIWDTPRDTKNLCLFGDQVRLQQVLADFLLNAIRFTPSSEGWVGIKGVSSRHRQGGGVHVVHFEFRVTHPGAGLPEELVQEMFDRGRGMTQEGLGLNMCRKLLKLMSGDVQYIREAGKCYFLVNVELPIAQRDDAGSVK

SEQ ID NO: 57 - protein, 1124 aa, Mougeotia scalaris
MSSSKRSQSSGRSSTQTRIQNRVTQASADAKLSTAFEVSSSSGGDSFDYTKSVTASLNPTEPLAAKSVTAYLQRMQRGSIIQSFGCMMAVEPGTFRIIAYSENVSEMLGVTPQSVPTGDHQNAIGIGTDVRSLLSPSSVSVVEKAVAANDVSMMNPIAVYSLATQKLFFAILHMNDVGLVIDLEPISSSSDSAMFSAGAVQSHKLAAKAISRLQSLPGGDICGLCDVVVEEVRELTGYDRVMAYKFHDDEHGEVVAEIRRSDLEPYLGLHYPATDIPQASRFLFIKNRIRMICDCTSPQVKVVQDSRIPQEMSLAGSTMRGVHGCHTQYMMNMGSTASLVMSVTINDTNEIAGGPGMKGRKLWGLIVCHHSTPRHIPFPIRSACEFLMQVFGLQLNMEVELAAQHREKHILRTQTLLCDMLLRDAPMGIVSQSPNVMDLVKCDGAALLFGGRCWLLGISPTQEQVKDIATWLISSHTDTTGLSTDSLVDAGYPKARELGVDVCGMAAARITENDFLFWFRGHAQKEVKWAGAKDGGSEEDGSRMHPRSSFKAFLEVVKQRSLPWEDVEMDAIHSLQLILRGSFQDIEDKEDRKIVHARLKEMHLQGMEELSSVASEMVRLIETATAPILAVDTAGCVNGWNFKISELTGLSIPEVMGKSLVKDLTHPSSKDTVEKLLYMALNGEEEQNVEIRLKTWGMQQGKGPVILMVNACASRDVSEKVVGVCFVAQDVTGEKIVQDKFTRIQGDYTTIVRSHNSLIPPIFGSDESGFCVEWNPAMERLSGVKREEAIGKMLTRELFGGILRLKNVDGLTKFMIVLNAAMSSHDTDKFPFTFYDRSGKIVEVLLTTSKRCNSEGVVTGVFCFLHTASSELQQALTVQKAAERVAEVKAKELAYIRQEIQNPLDGIHFARSFMEHTVLSEDQKQLIETSATCEKQLRRILADMDLASIEKGYLELETGEFSMATVMNSVVSQGMIQSTQKNLQLYCDTPPDFKSLSVFGDQVRLQQVLADFLLNAVQFTPPSGWVEIKVEPVVKKLPGGVSVANVDFRVSHPGEGLPEDLIDQMFDRADARVKSQEGLGLSICRKLVRLMNGEVQYRREGERNFFLLQLELPLAQRDDQASMK

SEQ ID NO: 58 - protein, 1136 aa, Picea abies
MSTTRPRAATHSASSGSVSRSSKHSARVITQTPVDAKLQAEFEGSVHSFDYTKSIDISGDSSSVPSETVKAYLQRLQKEMLIQPFGCVLAVEEGSCAVVGYSENAPEMLDVVGGAHAVPSIGGQQQEGGGGGGGLLRIGMDARTLFKPASAAALQKAATFADMHLVNPIFVRCNRSGKPFYAILNRIDAGLVIDFEPVMPSDVPVSAAGALQSYKLAAKAISRLQSLPGGDIRLLCDTVVQEVRELTGYDRVMAYRFHEDEHGEVVAEMRRPDLEPYLGLHYPATDIPQASRFLFMKNRVRMICDCCAPPVNVIQDKRLRQPLSLCGSTLRAPHGCHAQYMANMGSIASLVMSVTTNENGDDSEGGGQQQPQNRRKLWGLVVCHHTSPRVIPFPLRYACEFLMQVFGIQLNKEVELAAQLREKHILRVQPVLCDMLLRDAPVGIVSQTPNIMDLVKCDGAALLYGKRLWLLGTTPTEAQILDIADWLLEHHRDSTGLSTDSLAEAGYPGAASLGDAVCGIAAARITSKDFLFWFRSHTAKEIIWGGAKHDPNDKDDGRRMHPRSSFKAFLEVVKRRSLPWEDVEMDAIHSLQLILRDSFHDIDDSDSKTMIHARLNDLRLQGIDELSAVTNEMVRLIETATVPILAIDSNGLVNGWNTKAAELTGLLADEVIGRPLIDLVQHDSVEIVKKMLYLALQGEEEQNVEIKLKTFGIQEEKGPVVLIVNACSSRDLEENVVGVCFVAQDVTWQRIAMDKFTHLQGDYRAIVQNPNPLIPPIFGADEYGYCSEWNPAMEKLTGWKREEVIGKMLVGEVFGIHRMSCQLKGQDGLTKLRIVLNNAMAGKETEKFPFSFFDRHGKNTEALLSANKRTDAEGIITGVFCFLHVTSTELQQALQVQRMAEQAAMDRLKELAYIRQEIRNPLYGIIFTRKLMESTDLSEEQKQIVQTSALCQRQLVKVLDDADLESIEDGYLELDTIEFTLGTVLDAVVSQGMILSREKGLQLIRDSPEEIKTMCLYGDQLRLQQILSNFLINALRFSTSEGWVGNKVVPTKRHLGSGVNVMHMEFRITHSGQGIPEELIKEMFVHNQDMFQEGLGLYMCQQLVKIMNGDVQYLREAGRSSFIINVEFPLAQTDKQ

SEQ ID NO: 59 - protein, 1132 aa, Physcomitrella patens
MSTPKKTYSSTSSAKSKAHSVRVAQTTADAALQAVFEKSGDSGDSFDYSKSVSKSTAESLPSGAVTAYLQRMQRGGLTQSFGCMIAVEGTGFRVIAYSENAPEILDLVPQAVPSVGEMDTLRIGTDVRTLFTASSVASLEKAAEAQEMSLLNPITVNCRRSGKQLYAIAHRIDIGIVIDFEAVKTDDHLVSAAGALQSHKLAAKAITRLQALPGGNIGLLCDTVVEEVRELTGYDRVMAYRFHEDEHGEVVAEIRRADLEPYLGLHYPGTDIPQASRFLFMKNKVRIIADCSAPPVKVIQDPTLRQPVSLAGSTLRSPHGCHAQYMGNMGSIASLVMAVIINDNEEDSHGSVQRGRKLWGLVVCHHTSPRTVPFPLRSACGFLMQVFGLQLNMEVESAAQLREKHILRTQTLLCDMLLRDAPIGIVSQIPNIMDLVKCDGAALYYGKPFWLLGTTPTESQIKDIAEWLLEYHKDSTGLSTDSLADANYPAAHLLGDAVCGMAAAKITAKDFLFWFRSHTAKEIKWGGAKHDPGENHDGRKMHPRSSFKAFLEVVKRRSLPWEDVEMDAIHSLQLILRGSFQDIADSDTKTMIHARLNDLKLHDMDELSVVANEMVRLIETATAPILAVDSNGMINGWNAKIAQVTGLPVSEAHGRSLVKDLVTDESVAVVERLLYLALRGEEEQNVEIKLKTFGTQTEKGVVILIVDACSSIHVSENVVGVCFVGQDVTGQKMFMDKFTRIQGDYKTIVQNPHPLIPPIFGADEFGYCFEWNPAMEGLTGWKKDEVVGKLLVGEIFGMQMMCCRMKSQDAMTKFMIALNTAMDGQSTDKFTFSFFDREGKYVDVLLSTNKRTNADGVITGVFCFLQIASSELQQALKVQRATEKVAVAKLKELAYIVREIKNPLCGLTFTRQLLEDTDLSDDQQQFLDTSAVCEQQLQKSLNDMDLESIEDGYLELDTAEFEMGTVMNAVISQGMTTSREKGLQIFRETPREINTMRLLGDQIRLQQVLSDFLLNTVRFTPSPEGWVKIKVVPTRKRLGGSVHVVHLEFRVSHPGAGLPEELVLEMYDRGKGMTQEGLGLNMCRKLVRLMNGDVHYVREAMQCYFVVNVELPMAQRDDASSQCRSLYSYLLA

SEQ ID NO: 60 - protein, 1123 aa, Physcomitrella patens
MSTPKKTYSSTSSAKSKAHSVRVAQTTADAALQAVFEKSGDSGDSFDYSKSVSKSTAESLPSGAVTAYLQRMQRGGLTQSFGCMIAVEGTGFRVIAYSENAPEILDLVPQAVPSVGEMDTLRIGTDVRTLFTASSVASLEKAAEAQEMSLLNPITVNCRRSGKQLYAIAHRIDIGIVIDFEAVKTDDHLVSAAGALQSHKLAAKAITRLQALPGGNIGLLCDTVVEEVRELTGYDRVMAYRFHEDEHGEVVAEIRRADLEPYLGLHYPGTDIPQASRFLFMKNKVRIIADCSAPPVKVIQDPTLRQPVSLAGSTLRSPHGCHAQYMGNMGSIASLVMAVIINDNEEDSHGSVQRGRKLWGLVVCHHTSPRTVPFPLRSACGFLMQVFGLQLNMEVELAAQLREKHILRTQTLLCDMLLRDAPIGIVSQIPNIMDLVKCDGAALYYGKRFWLLGTTPTESQIKDIAEWLLEYHKDSTGLSTDSLADANYPAAHLLGDAVCGMAAAKITAKDFLFWFRSHTAKEIKWGGAKHDPGEKDDGRKMHPRSSFKAFLEVVKRRSLPWEDVEMDAIHSLQLILRGSFQDIDDSDTKTMIHARLNDLKLHDMDELSVVANEMVRLIETATAPILAVDSNGMINGWNAKIAQVTGLPVSEAHGRSLVKDLVTDESVAVVERLLYLALRGEEEQNVEIKLKTFGTQTEKGVVILIVDACSSIHVSENVVGVCFVGQDVTGQKMFMDKFTRIQGDYKTIVQNPHPLIPPIFGADEFGYCFEWNPAMEGLTGWKKDEVVGKLLVGEIFGMQMMCCRMKSQDAMTKFMIALNTAMDGQSTDKFTFSFFDREGKYVDVLLSTNKRTNADGVITGVFCFLQIASSELQQALKVQRATEKVAVAKLKELAYIRQEIKNPLCGITFTRQLLEDTDLSDDQQQFLDTSAVCEQQLQKVLNDMDLESIEDGYLELDTAEFEMGTVMNAVISQGMTTSREKGLQIFRETPREINTMRLLGDQIRLQQVLSDFLLNTVRFTPSPEGWVKIKVVPTRKRLGGSVHVVHLEFRVSHPGAGLPEELVLEMYDRGKGMTQEGLGLNMCRKLVRLMNGDVHYVREAMQCYFVVNVELPMAQRDDASSQM

SEQ ID NO: 61 - protein, 1130 aa, Physcomitrella patens
MSTPKLAYSSGSSVKSKHSVRVAQTTADAKLQAVYEESGDSGDSFDYSKSVHASKSTGENVSAQAVTAYLQRMQRGGLMQTFGCMLCVEESNFRVIAFSENAPEMLDLMPQAVPSVGQQEVLGIGTDARTLFTPSSAAALEKCAGTVDVTMLNPISVHCRSSGKPFYAILHRIDVGLVIDFEPVRSNDAIVSSAGVLQSHKLAAKAISRLQALPGGDIGLLCDIVVQEVRELSGYDRVMAYKFHEDEHGEVLAEIRRSDLEPYLGLHYPATDIPQASRFLFMKNKVRMIGDCFASPVKVIQDKDLRQPISLAGSTLRAPHGCHAQYMGNMNSIASLVMAVIVNDPDEDPNARGGQQRGRKLWGLVVCHHTSPRTVSFPLRSACEFLMQVFGLQLNMEVELAAQLREKHILRTQTLLCDMLLRDAPIGIVSQSPNIMDLVKCDGAALHYGKRFWLLGITPNDAQIKEIADWLLEHHQDSTGLSTDSLADAGYPGAAQLGDAVCGMAAAKITSKDFLFWFRSHTAKEIKWGGAKHDPDEKDDGRKMHPRSSFKAFLVVVKRRSLPWEDIEMDAIHSLQLILRGSFQDIDDSDTKTMIHARLNDLKLQDMDELSTVANEMVRLIETATAPILAVDSGGFINGWNAKVAELTGLPVEEAMGRSLVKDLILNESIDVVQRLLHLALQGDEEQNIEIQLKTFGPQKEKGAVILIVNACSSRDVQDNVVGVCFVGQDVTGQKQVLDKFTRIQGDYKAIVQNPNPLIPPIFGTDEYGYCSEWNPSMEKLTGWKREEVIGKLLVGEIFGIQLMCCRLKSQDAMTKFMIVLNGAMDGQDTDRFPFSFFDRQGKYVDPLLTVNKRTDAEGSITGVFCFLHTTSVELLQALTVQRSTEKVAFAKLKELAYIRQEIKNPLYGIVFTRNLMEDTDLSVDQRQLVETSAVCERQLRKILDDLDLESIEDGYLELDTTEFEMGTVMDAVVSQGMITSREKGLQLIRETPSEIKNMCLYGDQVRLQQVLADFLLNAVRFTPSSEGWVGIKVVPTKKRLGRGVHVMHVEFRVTHPGLGLPEELVHEMFGRGRGMTQEGLGLSMCRKLVKLMNGTVQYIRETGKSCFLVEVELPLAQRDDAGSVRSTVV

SEQ ID NO: 62 - protein, 1122 aa, Physcomitrella patens
MSAPKKTYSSTSSAKSKAHSVRVAQTTADAALHAVFEKSGVSGDNFDYSKSVSKSTAGSLHTGAVTAYLQRMQRGGLTQSFGCMVAVEETGFRVIAYSENAPEFLDLMPQAVPNIGEINTLGIGTDVRTLFTPSSAASLEKAAETQEISLLNPITVYCRSKKPLYAIAHRIDIGIVIDFEAVNMNDVTISADGALQSHKLAAKAITRLQALPGGDIGLLCDTVVEEVRELTGYDRVMAYKFHEDEHGEVVAEIRRTDLEPYLGLHYPATDIPQASRFLFMKNRVRMIGDCSAPPEKIVQDPNLRQPVSLAGSTLRSPHGCHAQYMGNMGSISSIVMAVIINDNEDDSRGSVQRGRKQWGLVVCHHTSPRTVPFPLRSACEFLMQVFGLQLNMEVELAAQLREKHILRTQTLLCDMLLRDAPTGIVSQVPNIMDLVKCDGAALYYGKRFWLLGTTPTESQIKDIAEWLLEYHKDSTGLSTDSLADANYPAAHLLGDAVCGMAAAKITSKDFLFWFRSHTAKEIKWGGAKHDPGEKDDNRKMHPRSPFKAFLEVVKRRSLPWEDVEMDAIHSLQLILRGSFQDIDDSDTKTMIHARLNDLKLHDMDELSIVANEMVRLIETATAPILAVDSNGMINGWNAKIAQETGLPVAEAMGRSLVKDLVMDESLEVVERLLYLALRGEEEQGVEIKLKTFGAQTVKGAVTLIVNACASRDVSENVVGVCFVGQDVTGQKMFMDKFTRIQGDYKTIVQNPHPLIPPIFGADEFGYCFEWNPAMEGLTGWKRDEVIGKLLVGEIFGMQKMCCQMKSQDAMTKFMISLNSAMDGQNTDKFSLSFFDREGRYVDALLSTNKRTNADGAITGVICFLQIASSELQQALRVQQATEKVAIAKLKELAYIRQEIKNPLCGITFTRQLLEDTDLSNDQKQFLDTSAVCEQQLQKVLNDLDLESIEDGYLELDTAEFEMRTVMDAVISQGMTISREKGLQIIRETPREIITMRLFGDQVRLQQVLSDFLLNAVRFTPSSEGWVKIKVVPTRKRLGGNEHVMHLEFRVSHPGAGLPEELVLEMFDKGKGMTQEGLGLNICRKLVRLMNGDVQYVREAMQCYFVLYVELPLAQQDDAASQM

SEQ ID NO: 63 - protein, 1126 aa, Physcomitrella patens
MSTTKLAYSSGSSVKSKHSVRVAQTTADAKLQAVYEESGDSGDSFDYSKSVHASKSTGENVPALAVTAYLQRMQRGGLVQTFGCMLCVDESSFRVIAYSENAPEMLDLMPQAVPSVGQQEVLGIGTDARTLFTPSSAAALEKCAGAVDVTMLNPISVHCRSSGKPFYAILHRIDVGLVIDFEPVRPNDAVVSSAGALQSHKLAAKAISRLQALPGGDIGLLCDTVVEEVRQLSGYDRVMAYKFHEDEHGEVLAEIRRSDLEPYLGLHYPATDIPQASRFLFMKNRVRMIGDCYAPPVKVVQDKDLRQPISLAGSTLRAPHGCHAQYMGNMNSIASLVMAVIVNDPDEDPNSRGGQQRGRKLWGLVVCHHTSPRTVSFPLRSACEFLMLVFGLQLNMEVELAAQLREKHILRTQTLLCDMLLRDAPIGIVSQSPNIMDLVKCDGAALYYGKRFWLLGITPNEVQIKEIADWFLEHHQDSTGLSTDSLADAGYPGAAQLGDAVCGMAAAKITPRDFLFWFRSHTAKEIKWGGAKHDPDEKDDGRKMHPRSSFKAFLEVVKRRSLPWEDIEMDAIHSLQLISRGSFQDIDDSDTKTMIHARLNDLKLQGMDELSTVANEMVRLIETATAPILAVDSSGFINGWNAKVAELTGLPVGEAMGRSLVKDLILEESIDVVQRLLYLALQGEEEQNIEIQLKTFGPQKEKGAVILIVNACSSRDVQDNVVGVCFVGQDVTGQKQVLDKFTRIQGDYKAIVQNPNPLIPPIFGTDEYGYCSEWNPSMEKLTGWKREEVLGKLLVGEIFGMQLMCCRLKGQDAMTKFMIALNSAMDGQDTDRFPFSFFDRQGKYVDALLTVNKRTDAEGSITGVFCFLHTTSVELLQALTVQRATEKVAFAKLKELAYIRQEIKNPLYGIMFTRNLMEDTDLSEDQRQFVETSAVCERQLRKVLDDMDLESIEDGYLELDTNEFVMGTVMDAVVSQGMITSREKGLQLIRETPREIKNMCLFGDQVRLQQVLADFLLNAVKFTPSSGGWVGIKVVPTKKRLGGGIHVMHLEFRVTHSGMGLPEELVHEMFDRGRGMTQEGLGLSMCRKLVKLMNGNVQYIRETGKSYFLVEVELPLAQRDDAGSVR

SEQ ID NO: 64 - protein, 1131 aa, Pinus sylvestris
MASNSRHTQSQSTGSNNRRSSTNTNTTTNKATAMAQYNSDARLLQVFEQSGESGKSFDYTRSIQVHNRAVPEQQITAYLSRIQRGGRIQPFGCVLAVEETTFRIIAYSENEEMLDLGAQSVPSMEKPQQDVLTIGTDVRTLFTAASAHSLEKAAVAQEISLMNPIWVHCKNSRKPFYAIVHRIDVGMVIDLEPLRTGDAFMSAAGAVQSQKLAVRAISRLQSLPCGDVGLLCDTVVENVRELTGYDRVMVYKFHEDEHGEVVAEIRRSDLEPYLGLHYPATDIPQASRFLFMQNRVRMICDCMATPVKVIQSEELMQPLCLVGSTPSAPHGCHAQYMANMGSIRSLLMAVIINGNDDEGGGSGRNSMKLWGLVVCHHTSPRAVPFPLRYACEFLMQALGLQLNMELQLAAQLTEKHILRTQTLLCDMLLRDAPMGIVTQSPSIKDLVKCDGAALYYGGMCWMLGVTPTEAQIKDIADWLLEHHGDSTGLSTDSLADAGYPGAASLGDAVCGMASARITSKDFLFWFRSHTAKEMKWGGAKHHPDDKDDARRMHPRSSFKAFLEVVKRRSLPWDNVEIDAIHSLQLILRCSFRDIDDSGTKTMVHSRLNYLRLQGIDELSSVASEMVRLIETATAPILAVDYNGLVNGWNAKVAELTGLPVGEAMGMSLVQDLVFEQSVERVEKMLHNALRGEEEKNVEMMLKTFGPQKEKEAVILVVNACSSRDFTDNIVGVCFVGQDVTSQKVVMDKFIRIQGDYRSIVQSPNPLIPPIFASDEYACCSEWNAAMEKVTGWTHDEVIGKMLVGEIFGGCCRLKGQDAVTKFTIVLHQCNHGQEIEKFPFAFFDKQGKYVEALLTANKRTDADGRITGSFCFFRIASSELQHALEVQRQQEKKCFARLKELAYIRQEIKNPLYGMMFTRKLLEETDLSDDQKQFVETSAVCERQMQKVMDDMDLESLEDGYMELDTAEFILGTVIDAVVSQGMIVLREKGLQLIREIPGEVKTMRLYGDEVKIQQILADFLLNVLRFTPSPEGWVAIKVFPTLKQLGGGLHVVHLEFRITHPGLGLPAELVQDLFDRSQWATQEGVGLSMCRKLLKLMNGDVRYIRESGICYFLVNVEFPMAQREDAASIK

SEQ ID NO: 65 - protein, 1134 aa, Selaginella martensii
MSTTKLTYSSGSSAKSKHSVRVAQTTADAKLHAVYEESGESGDSFDYSKSINATKSTGETIPAQAVTAYLQRMQRGGLVQPFGCMLAVEEGSFRVIAFSDNAGEMLDLMPQSVPSLGSGQQDVLTIGTDARTLFTAAASALEKAAGAVDLSMLNPIWVQSKTSAKPFYAIVHRIDVGLVMDLEPVKASDTRVGSAAGALQSHKLAAKAISRLQSLPGGDIGLLCDTVVEEVRDVTGYDRVMAYKFHEDEHGEVVAEIRRSDLEPYLGLHYPATDIPQASRFLFMKNRVRMICDCSAPPVKITQDKELRQPISLAGSTLRAPHGCHAQYMGNMGSVASLVMAMIINDNDEPSGGGGGGGQHKGRRLWGLVVCHHTSPRSVPFLRSACEFLMQVFGLQLNMEAAVAAHVREKHILRTQTLLCDMLLRDAPIGIVSQSPNIMDLVKCDGAALYYGKRFWLLGITPSEAQIKDIAEWLLEHHKDSTGLSTDSLADAGYPGAASLGDEVCGMAAAKITAKDFLFWFRSATAKEVKWGGAKHDPDDKDDGRKMHPRSSFKAFLEVVKRRSLPWEDVEMDAIHSLQLILRGSFQDIDDSDTKTMIHARLNDLKLQGMDELSTVANEMVRLIETATAPILAVDSSGFINGWNAKVADVTGLPVTEAMGRSLAKELVLHESADMVERLLYLALQGDEEQNVELKLKTFGGQKDKEAVILVVNACASRDVSDNVVGVCFVGQDVTGQKVVMEKFTRIQGDYKAIVQNPNPLIPPIFGADEFGYCSEWNPAMEKLSGWRREEVLGKMLVGEIFGIQMMYCRLKGQDAVTKFMIVLNSAADGQDTEKFPFAFFDRQGKYVEALLTATKRADAEGSITGVFCFLHIASAELQQALTVQRATEKVALSKLKELAYIRQEIKNPLYGIMFTRTLMETTDLSEDQKQYVETGAVCEKQIRKILDDMDLESIEDGYLELDTTEFMMGTVMDAVISQGMITSKEKNLQLIRETPKEIKAMFLYGDQVRLQQVLADFLLNAIRFTPSSENWVGIKVATSRKRLGGVVHVMHLEFRITHPGVGLPEELVQEMFDRGRGMTQEGLGLSMCRKLVKLMNGEVEYIREAGKNYFLVSLELPLAQRDDAGSVKFQASS

SEQ ID NO: 66 - protein, 765 aa, Nostoc sp.
MRIDVESQNINVTSLKEAPIHLSGQIQPHGVLLVLEEPGLKILQVSNNTWGILGINAENILQKKLEDLLDSFQIERIQSGLSSGNLEFINPTKIWIRKKGDDYAVFDAVFHRNTEGFLILELEPAITQENIPFLSFYHLAKASINQLQKTANLRDFCQIIVQEVRKVTDFDRVMLYKFDDDGHGSVIAEEKLDSLEPYLGLHYPESDIPKPARKLFISNSIRVIPNAQAQAIQMIPALNPVSDRPVDLTNSILRSAANCHLEYLHNMGVGASLTISLIKDNKLWGLIACHHLSAKYVSYELRKACEFLGRVIFAEISAREETEDYDYRMNLTHIQSLLVEYMSQEDNFVDGLIKHQPSLLDLTSAQGAAVCFGDHCTLIGETPKAEDLVFLVQWLKNNVEEEVFYTDSLPQVYPDAERYKNVASGLLAIPISQRNYVLWFRPEVIQTVNWGGDPNQPFEVNKLDGNVRLCPRKSFELWKETVRLTSLPWRYVEIRAALELRKAIVNIVLRQADELAQLAHDLERSNAELKKFAYVASHDLQEPLNQVANYVQLLEMRYQDQLDADANEFITFAVEGVSLMQTLIDDVLAYSKVDTQAIAFQLTEVEKALDKALGNLRQRIAETGANITHDPLPTVMAGSTQLMQLFQNLIANAIKFRSEEAPQIHIGAERLEDEWLFSVRDNGIGIDPQFSDRIFVIFQRLHTRDEYHGTGMGLAICKKIIECHRGRIWVESQLGEGATFYFTIPVGGRERERRNGRKTQNNLFS

SEQ ID NO: 67 - protein, 748 aa, Synechocystis sp.
MATTVQLSDQSLRQLETLAIHTAHLIQPHGLVVVLQEPDLTISQISANCTGILGRSPEDLLGRTLGEVFDSFQIDPIQSRLTAGQISSLNPSKLWARVMGDDFVIFDGVFHRNSDGLLVCELEPAYTSDNLPFLGFYHMANAALNRLRQQANLRDFYDVIVEEVRRMTGFDRVMLYRFDENNHGDVIAEDKRDDMEPYLGLHYPESDIPQPARRLFIHNPIRVIPDVYGVAVPLTPAVNPSTNRAVDLTESILRSAYHCHLTYLKNMGVGASLTISLIKDGHLWGLIACHHQTPKVIPFELRKACEFFGRVVFSNISAQEDTETFDYRVQLAEHEAVLLDKMTTAADFVEGLTNHPDRLLGLTGSQGAAICFGEKLILVGETPDEKAVQYLLQWLENREVQDVFFTSSLSQIYPDAVNFKSVASGLLAIPIARHNFLLWFRPEVLQTVNWGGDPNHAYEATQEDGKIELHPRQSFDLWKEIVRLQSLPWQSVEIQSALALKKAIVNLILRQAEELAQLARNLERSNADLKKFAYIASHDLQEPLNQVSNYVQLLEMRYSEALDEDAKDFIDFAVTGVSLMQTLIDDILTYAKVDTQYAQLTFTDVQEVVDKALANLKQRIEESGAEIEVGSMPAVMADQIQLMQVFQNLIANGIKFAGDKSPKIKIWGDRQEDAWVFAVQDNGIGIDPQFFERIFVIFQRLHTRDEYKGTGMGLAICKKIIEGHQGQIWLESNPGEGSTFYFSIPIGN

SEQ ID NO: 68 - protein, 760 aa, Crocosphaera watsonii
MISNSHITQDINLKRLEELQIHLWGKIQPHGVLFVLDESNLKIVQTSSNTKQFFGIIPQEIVNLTLDDIFDSFQIEQLKIGLENNNLDFINPTKLWARVDGDNYVIFDGVFHRNGEGFLILELEPSYFSRKYPLFKFLSPSESIYSQLQTNANLTEFCQIIVQEVRKMTGFDRVMLYKFDEDDHGEVIAEDKLAELEPYLGLHYPASDIPLPARRLFSSNYIRLIPDAKATGIDLFSKLHPLNDTALDLTHSILRSASPCHLEYLHNMGVGASLTISLIDDRKLWGLIACHHLTPKYVPYELRKACEFLGQVVFSEISAKEETKDYDYRMKLTRIQGALIESMSQADNFIEGLINSNQNLLDLTSSQGVAVCVGEEYNLIGNTPKEEEVKYLLQWLKKNIDEEVFSTPSLPHLYADARNFKNVASGLLAIKISHRNYILWFRPEVIQTVNWGGDPSKAYEMQKIDGNLRLCPRKSFELWKETVRLTSLSWKPIEIKAALGLKEAIVNIILRQADELAELAHDLELSNAELKKFAYVASHDLQEPLNQVSNYVQLLEMRYDEALDEDGKEFINFAVEGVSLMQTLIDDVLAYSKVDIRDIKFDLTESENALEKAIANLRGRIAETNAIITHDPLPTVMANSTQLIQLFLNLISNAIKFRSEATPEIHIQAQRLEDEWLFSVEDNGIGIDPRFSDRIFIIFQRLHTRDEYPGTGMGLAICKKIMECHRGKIWVESEIGQGATFYFTIPVGGTERDRKRGSTR

SEQ ID NO: 69 - protein, 768 aa, Nostoc punctiforme
MEMNLQFPGINLISLKEAPIHISSQIQPHGVLLVLEEPELKILQVSTNTLKVFGIAPENMLHKKLEDLLDPFQIERIKTGLSGENLDFINPTKVWVRKKGDEYVVFDAIFHRNIEGFLILELEPAITQENIPFLSFYHLARASINQLEKTANLRDFCQVIVQEVRKITEFDRVMLYKFDDDGHGSVIAEEKLESLEPYLGLHYPESDIPKPARKLFAANSIRIIPDAYSQPVKLFPVNNPISDRPINLTNSILRSAASCHTEYLHNMGVGASLTISLIKDQKLWGLIACHHQSPKYVSYELRKACEFLGRVIFAEISAREETEDYYHRINLTHLQSILIEYMSQEENFIDGLVKNPQHLLDLASAQGAAVCFAGNCTVVGETPREEDLNFLVQWLKNNVEEEVFYTDSLPQIYPDAESFKNVASGLLAIPIAKRTYVLWFRPEVIQTVNWGGDPNKAFEVSQSEGNVRLCPRKSFELWKETVRLTSLPWKDVEVKAALELRKAIVNIVLRQADELAQLAQDLERSNAELKKFAYVASHDLQEPLNQVVNYVQLLEMRYSEELDEDAQEFISYAVQGVSLMQTLIDDVLAYSKVDMQAIAFQMNDVETALMRGLGNLRQRINETGATITHDPLPTVMADSTQLMQLFQNLIGNAIKFHSDQPPQIHVGAERIEDAWLFSVRDNGIGIDPKFSDRIFVIFQRLHTRDEYTGTGMGLAICKKIVECHRGRIWVESELGQGATFYFTIPVGGRELERRNGRKTQNHLFGRGQ

SEQ ID NO: 70 - protein, 422 aa, Crocosphaera watsonii
MRNLSLNDYKKYENFDFRYPGSIQPHGVLLVIDIKTFTIIQVSENTKRFLGVKPKTLLGKPLTYLMYLKQIKNIKNILENNNHFVDIIKLKKKKYDTQFKGIFHRVQDSIIGELETFKLNDNNKNIDYYKLFQDAIINTGKTNDLKKLSAKITEEIRKITKFDRVLIYRFENDDSGVVIAENKREDIESYLGLHYPYYDIPNPARQFFSKKLLRMIPNIHDEPIPILPRKHPLKKKKLDLQNAFLRSIAPCHIEYLKNMGVTASFNISLLKENKLWGLIACHHYSPKYVIYEIRKICELLGEIFSLKLMYEEEKSFRQYRQTIKEIKKRIKEELSKNKNKHDFIDNIIQKNGDSFLKLISARGIAICLDNKIYVKGNTPKKKQIKALINDFLLPKKKDVFLQIFSQSHILFPEKLKKLLQEF

SEQ ID NO: 71 - protein, 775 aa, Nostoc punctiforme
MSQPENTTTQATALTNHDRKPIHIPGSIQPHGILLALSTQLEIVQVSNNTQVYLCKAPEDLLGRPLSYLLEPQPVEIVKQCLVKKVGSANAFKVLINTLYGEIYFDAIAHRTEEAVILELEPTDSEFEVSFLNFHSFASEAIAKMQRTSNLGEFLHLVAQEVQKIISFDRVMVYQFDESEAGSVVAEVKREDLSPYLGLHYPATDIPAQARELYTRCFLRFLPDLTAEPVKLVPTENPTTHQHLDLSYCLLRSFDWCCAEYHQNMGVKALLVISLIQEQKLWGLISCHHQTPKYISYEVRKMCEFLGQIVSSELAHKISSSEWDYKVKLKSLQSEFLESISQADNFIDALIKPEIRLLDFVSASGAAVCLDNEINLVGTTPNIDEVRALIEWADTQVTDNLFSTDSLPKLYPEALIFKDTASGLLLLRISKVRRYYILWFRPEVIQTVHWAGNPQESIKAEGDGSYTLSPRKSFEQWQETVRLTSLPWKGCELESAIALSNAIVGIVLSKADELAKINLELERSNQELASFAYAASHDLKEPLRGIYNFSTVLLEDYAQVLDDDGIECLQTVVSLSVRMETLINALLRLSQLGQAHLREQATDLNELLNQVIDVFRASRQDSGLVDIRIPRPLPTIQCDRVLVNEVFSNLLGNAFKYNDKAEQWVEIGYLSQEEGQGVGSRGQGAGGAGEAIIHQSPIPNAPCPIFYIRDNGIGIPQHHLETIFRLFKRLHSQEKYGGGAGAGLAIVKKIVELHNGQIWVESTLGVGSIFYFTLE

SEQ ID NO: 72 - protein, 767 aa, Tolypothrix sp.
MVSEFQAQSINVNSLKEAAIHVCSQIQPHGVLLVLGEPELNILQISSNTWSVFGILPEDVLQKKLEDLLDPFQIERIKAGILEGNLDYINPTKIWVRKKGDEYVVFDAVFHRNPEGLLILELEPAISQENIPFLSFYHLARASINQLEKTTNLRDFCQIIVQEVRKVTGFDRVMLYKFDDDGHGSVIAEEKLDSMEPYLGLHYPESDIPKPARKLFASNFIRLIPDAHAEPVQILPINHPQSQQPIDLTNSILRTAANCHLEYLHNMGVGASLTISLIKDGKLWGLIACHHQTPKYVSYEFRKACEFLGRVIFTEISTREETEDYDYRMNLAYIQTVLVEYMSQEENFIDGLVKHQPNLLNLTSAQGAAVCFGDRCTVIGQTPKEEDLNFLLQWLKNNVREEVFYTDSLPRIYPDAEKFKNVASGLLAIPISKRNYVLWFRPEVIQTVNWGGNPNEAFEVSQTEGNLRLVPRKSFELWKENVQLTSLRWKAVEIKAALELRKAIINIVLRQADELAQLAHDLERSNAELKKFAYVASHDLQEPLNQVANYVQLLEMRYENELDEDAKEFINFAVEGVSLMQTLIDDVLAYSKVDMQASAFQLTEVETPLNRSLSNLRGRIHETGAMITHDPLPTVMADSTQLMQLFQNLIANAIKFRSEQPPKIHIGAERLEDEWLFSVQDNGIGLEPRFSDRIFVIFQRLHTREEYPGTGMGLAICKKIIECHRGRIWVESQLGEGATFYFTIPVGGRERERRNGRQTQKDLFGRG

SEQ ID NO: 73 - protein, 751 aa, Nostoc sp.
MNINDITIPFQVDLSNCSKEPIHIPGLIQPHGVLLVLQEVDLTILQVSNNTFNILGRHPEQLLNQHLSCLLEAEQLSLLKDCLAQEDLQIINPLEFIIKSHNESISFDVIAHRSNNLLILELEANLSDKTHSFFRFYHLVKLAMLKLQGTATTTEISQILAQEVRKITGFDRVMVYRFDEQWNGKVIAEVKPEYLTSYLGLNYPASDIPQQARKLYSQNWLRLIPDAKYQPVPIVPINNPLNDQPLDLSRSVLRSVSPLHIEYMQNMGVTASMSISIMKNQKLWGLIACHHQSPKYIPYEIRSACEFLGQMTSVEMSAKEDSEDTEDKIQVKSVHSKLVQYMSAENDFINALIDHQPNILDLVKAQGAAVCFNGNSCTVGQVPPMPDIQVLVEWMSQNIHEEIFATDSLATVYPDAEKLRDVASGLIALSISRSQKNYILWFRPEVVRTVDWGGNPHKPVEVIANGEIRLSPRKSFDLWKETVLLKSQPWKSHEVNAALELRSAIIGIVLQKADELAQLNIELERSNQELDAFAYIASHDLKEPLRGIHNYSNFLMEDYGEIIDAPGKEKLLTLIRLTQRMEDLIDSLLHFSRLGRVDLSMQDTDLNEIVHRILDMLSGRIEETGVEIRILQLLPVVYCDRIQIGEVFSNLIANSIKYNDKANKWIEIGYIDNPPLPPTFYVRDNGIGIREKHFETIFRIFKRLHSPSKYGGGTGAGLTIAKKIVERHGGKIWVESTYGEGSTFYFTLQDV

SEQ ID NO: 74 - protein, 745 aa, Agrobacterium tumefaciens
MQRERLEKVMSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 75 - protein, 736 aa, Agrobacterium tumefaciens
MSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 76 - protein, 751 aa, Anabaena variabilis
MNINDITIPFHVDLSNCNKEPIHIPGLIQPHGVLLALQEIDLTILQVSNNTFNLLGRHPEQLLNQHLSCLLEAEQINLLQDCLTQEDLQIINPLEFIIKSHNQSINFDVIAHRSNGLLILELEANLSDKNYSFFRFYHLVKLAMLKLQGAATTTEISQILAQEVRKITGFDRVMVYRFDEQWNGKVIAEVRPEYLTSYLGLHYPASDIPQQARKLYSQNWLRLIPDAKYQPVPIVPTNHPLNNQPLDLSRSVLRSVSPLHIEYMQNMGVTASMSISIMKNQKLWGLIACHHQSPKYIPYEIRSACEFLGQMTSVEMSAKEDSEDTEDKIRVKSVHSKLVQYMSAENDFINALIDHQPNILDLVNAQGAAVCFNGNFRTVGQVPPIPDIQVLVEWMSQNIHEEIFATDSLATVYPDAEKLREVASGLIALSISRSQKNYVLWFRPEVVRTVDWGGNPHKPVEVIANGGIRLSPRKSFELWKETVLLKSHPWKSYEVNAALELRSAIIGIVLQKADELAQLNIELKRSNQELDAFAYIASHDLKEPLRGIHNYSNFLMEDYGEIIDAQGKEKLLTLIRLTQRMEDLIDSLLHFSRLGRVDLSMQDTDLNEIVHRILDMLSGRIEETGVEIRIVQLLPVVYCDRIQIGEVFSNLIANSIKYNDKANKWIEIGYIDNQPLPPTFYVRDNGIGIREKHFEAIFRIFKRLHSPNKYGGGTGAGLTIAKKIVERHGGKIWVESTYGEGSTFYFTLQGV

SEQ ID NO: 77 - protein, 752 aa, Cytophaga hutchinsonii
MKIKDIVNRDLVNLQNCDQEPIHIPGSIQPHGFLIAITKETWEIRFCSENVIDFIGLSHKQLLGKKITEIFDDIFFGKVIQCKDYAVGESKLIQGKIEDKEFDFTAHQNEDVIILESEIHIDNTPKNDLFDMSKQFMDYMEDSHTLIRLCELVASGIKKVTDYDRVMIYRFDKDYNGEVIAETKQDKLESFLGLHYPHTDIPVQARELYIKNLLRVIGDVNYKPVPIYTIDDSENQNLDLSCSVLRSVSPIHVQYLHNIGVGATLTISLIHKKKLWGLVACHHYSPKYLHYETKLAAKLQGHFITSQIEIREQNEQYATSQKLHQAVDDLISRKFSADRNSLKDIVIDSNVLQLCKAAGISILIDKKEVYKSGLTPADGDIQKLAEYVKHAIDKEQYATHFITAELPDFKNITASGIAGINYHALDKTSNSCIMWYKPETITEVKWAGDPNKAIEKDKNGLSPRKSFELWGEKVKNQSIPWSQPDLIASSNFANFLQKHLGYIFLAEEEEKQRQMTEILKEVNSELENINWISTHDLQEPLRKIQIITSYVLSVENTLSEASYEKLQKINKSANRMQALISDILRYTKLKASTEILESVDLKNIVTEVIQEVDDALEAKKANIYISDLPEMSGIPFLLAQLFLNLISNSLKFADATRVLSIHIVQEGIIVKEEQEYYKISYTDNGIGFNKDYNELIFKIFSRLHSVAEYPGSGIGLALCKKIMKTHKGFIEAQGIPEKGAIFYLYFPVSKNS

SEQ ID NO: 78 - protein, 506 aa, Cytophaga hutchinsonii
MSKQNYDSKFCGSLPISFVNQIQDYGFLLVCDPALIVLQVSDNAEAFTRISYQSFIDKNLKELLTADSFQLLQEKLSSKAQKRFTCTLEFYGGVRTSFLTLIHVKEEYILFEFEPSDDTDIKGFREVYQQIHEASAAIQQSQELGESLSIAVKELKTFSGFDKVMIYKFDEDWNGHVLAEAMEPGMESYLGITFPASDIPKQARELYLKNPYRLIPDREYKPSKLYPVINPASSGFVDLGVCNLRGVIKVHLEYLTNMNVKSSMSTRILKDNTLWGLIACHHREKKFLNFDQCSVFEMFSNVVSTRLSALETEQNLTKTTENQALMNSIIEELYSQTMLINAIDNCAALIMQLLDCTGLVHIRESKVKSFGACPSASSIHELVIWLQMKNFTTLYATAALTEAYEDAAAIASVASGLLAFPVIPDKGEYILCFRAEILQRIDWGGNPNEAIRFNEDMKTYHPRHSFEIWKEEIKSTSQPFQEYEMNFAKELQRIFIETRLKEQNRR

SEQ ID NO: 79 - protein, 755 aa, Deinococcus radiodurans
MSRDPLPFFPPLYLGGPEITTENCEREPIHIPGSIQPHGALLTADGHSGEVLQMSLNAATFLGQEPTVLRGQTLAALLPEQWPALQAALPPGCPDALQYRATLDWPAAGHLSLTVHRVGELLILEFEPTEAWDSTGPHALRNAMFALESAPNLRALAEVATQTVRELTGFDRVMLYKFAPDATGEVIAEARREGLHAFLGHRFPASDIPAQARALYTRHLLRLTADTRAAAVPLDPVLNPQTNAPTPLGGAVLRATSPMHMQYLRNMGVGSSLSVSVVVGGQLWGLIACHHQTPYVLPPDLRTTLEYLGRLLSLQVQVKEAADVAAFRQSLREHHARVALAAAHSLSPHDTLSDPALDLLGLMRAGGLILRFEGRWQTLGEVPPAPAVDALLAWLETQPGALVQTDALGQLWPAGADLAPSAAGLLAISVGEGWSECLVWLRPELRLEVAWGGATPDQAKDDLGPRHSFDTYLEEKRGYAEPWHPGEIEEAQDLRDTLTGALGERLSVIRDLNRALTQSNAEWRQYGFVISHHMQEPVRLISQFAELLTRQPRAQDGSPDSPQTERITGFLLRETSRLRSLTQDLHTYTALLSAPPPVRRPTPLGRVVDDVLQDLEPRIADTGASIEVAPELPVIAADAGLLRDLLLHLIGNALTFGGPEPRIAVRTERQGAGWSIAVSDQGAGIAPEYQERIFLLFQRLGSLDEALGNGLGLPLCRKIAELHGGTLTVESAPGEGSTFRCWLPDAGPLPGAADA

SEQ ID NO: 80 - protein, 744 aa, Gluconobacter oxydans
MDLHLTVQRSLAPEPGCSLEHAVMTSCDREPIHRPDAIQPYGLLLVVDSTSLKIIGGAGDIEGRLAPDWLGRPLADILKIPESRLHDEKRPSLSDLRVAGLKDETFSILRHAQGTHLLIELEPVEAHNLLTWDIFGEIDSTADRFERCPDTTSVCRQGAAIFRRLTGFDRVLVYRFMEDGTGRVVGESRNDAFPSLMNHHFPASDIPTQARALYLRNRIRVIPDITYEAAPIRPPEAGLAGLDLSDVQLRSVSPIHLQYMANMGTRASASVSLVVDGVLWGLIACHNATPRCLSEDIRAACRTLAGVMSRQLRNKEELVTYQERLRLRNAMEFVTSHFEVRHPIESNLRSFMGELQSLFPCNGFAVISDQTITGTGVLPDAENLHRLHDWLRLGTNGGIFVSTMLGKDYPPAAEWPERSAGLLAITLPFRTPTCLIWSRVEIIQTIEWAGNPHKDTTEGSDVLRPRASFRTWEQTIRGHSTRWTSEQKQAARRLRRVLIADYQTQQLRELNATLAATLEERESLLRQKDFLIREVNHRVQNSLQMVASFLKLQARSASNEETTTALTEAQHRIAAIGLVHRRLYRDEHFGIVDLGRYLEELMEELCSSLGGDWQEQLHLSLFPIMISADRAINIGLVLTELVINASKYAYDGKAGPLHVGLAQTSDRLVLTVSDQGECTPQLKGTGFGTRMMNAVVNSLSGTLTYTTLTPGLEAVMTLPLDSILPSEADASTEAALSQPPYPYP

SEQ ID NO: 81 - protein, 798 aa, Kineococcus radiotolerans
MATGASMQPGSFTPGYGAVDLTTCEREPIHIPGAIQPHGVLLAVERGDHRVVVASANAAGFFGRPLPEVLSSSLADLLGADLTERVRGADLLDNLDEVLHARLPGPGGSAGADAVEADVVLHVSGERLVVEIEPSPPHTAPVSYRATRGAIARLAGTRGIEGLCERLVREVRVLTGFDRVMAYRFDAQWNGEVIAEDRREDLDTFLGLHYPASDIPAQARRLYTLNWMRLIADVDYVPSPLHPLLDPGTGAPLDLSHSVLRSVSPIHVEYLKNMGVGASMSISLIVEGRLWGLVACHHYSGAHRPGYDAQSAAEFLSQTASQLIGERARSQERDGALAAQELLSDITAAVSASGREPLTTLIEEPRLLQLLDAGGAALWTGHELLTSGQVPPSAQLRRIAALLARADGAPTFTDHLPTLDPGLAEVAQTAAGALRVGIDGTGWLLWLRPERPRLLDWSGDPHHAEITRVEGLEVRISPRKSFEKWSEVVRGRSTTWRSWHAATADRLRTQVTGIMLGRSRGQIAIAESLQRAVVLDEAPHVPGVEVLARYRPAEGSQLGGDWWDVLPLEAGRVAIVVGDVAGHGVHAAAAMAQLRTALRAYLLEGHSPASALDRLDTLVSTLLGNHTATALIAVVHPAGDHADGGGVDPGRDPGPRVDDGAATIELASAGHLPPLLVDAAGTSVVHVPSRPMLGLGFGPTAGLVSESVRAPLPPGAVLLMYTDGLVERRDAGLEETTGVLAETATRAAADLLPRSRGGMAAVADRLLTAVPGDAGDDTTLVLVRPAHPAAEPAARTEG

SEQ ID NO: 82 - protein, 502 aa, Magnetospirillum magnetotacticum
MVDTGSRSEPGLQGCESERLHLSGEIQPFGALLRLDPDGQVSHASANCGAVLGIPPEALLGQIPGPLLGGLVGLDELTPLGGFPILRTKAFTAHGDALDLAVSPSGEGLLLEFEPTGDFSGTHSLKLKSLEAIHLLHSPTVREQPNASFQILTETIADLTGYGRVLIYRFADDWSGEVVAETLRRPMQSYQGLHFPAADIPVIARDLYTLNRQRYIRDALAGSVPILGCDPADGAPDQTFGDLRSVSPMHLTYLGNMGVRASFSASILMRGKLWGLIACHHPEPKPLSLDVRQQLVKIARDFSVGLLVYIASIHLKFIDGIQREVRTMLDSAGHLDLTQGLVRCQDRFLALVGADSAAILTDDSVIRLGDAPATDDLALIDHWFDSQDGKGFASTAHLAAQIPEAETFRAQASGVIALRVRLAWLSGSSLRLFWFRREWPHLVQWAGDPTKPGGSGGVLTPRQSFTTWSELARGRARPWELPDLLAAKTLRACLCSLKVPAA

SEQ ID NO: 83 - protein, 728 aa, Pseudomonas aeruginosa
MTSITPVTLANCEDEPIHVPGAIQPHGALVTLRADGMVLAASENIQALLGFVASPGSYLTQEQVGPEVLRMLEEGLTGNGPWSNSVETRIGEHLFDVIGHSYKEVFYLEFEIRTADTLSITSFTLNAQRIIAQVQLHNDTASLLSNVTDELRRMTGYDRVMAYRFRHDDSGEVVAESRREDLESYLGQRYPASDIPAQARRLYIQNPIRLIADVAYTPMRVFPALNPETNESFDLSYSVLRSVSPIHCEYLTNMGVRASMSISIVVGGKLWGLFSCHHMSPKLIPYPVRMSFQIFSQVCSAIVERLEQGRIAELLRVSTERRLALARRARDADDLFGALAHPDDGIAALIPCDGALVMLGGRTLSIRGDFERQAGNVLQRLQRDPERDIYHTDNWPQPSEDSPDGGDCCGVLAIRFHRQESGWIFWFRHEEVHRIRWGGKPEKLLTIGPSGPRLTPRGSFEAWEEVVRGHSTPWSETDLAIAEKLRLDLMELCLNHAAEVDRMRQRLIAVLGHDLRNPLQSISMAAALLSSSDTRTTELRQHISASSSRMERLVSQILDMSRLQSGIGLTVNPVDTDVSQLVRQIVCETDVAYPGLVIEIAIDPQVRAVVDPDRYAQVAANLLSNARHHGLPGRPVLVTLTRQGDEVCLSVLNETSGLSEAQLANLFEPFKRESADNQRNRNGLGIGLYISQAIAQAHQGRIDVDCRDDVITFCLRLPVRQAETGSSS

SEQ ID NO: 84 - protein, 745 aa, Pseudomonas fluorescens
MNPQDKEAFEELLANCADEPIRFPGAIQPHGLLLTLSEPDLSIIQISANVETLLARPAQELIGQPLQSLIGDAHAAQVREALQQAALSDAPPLHFRLNGTAFEGLLHRHQDVLILELEIHVENFQPRNVAGTETHLGRMLARLQKAQSLQALYDISVKEIQAMTGYDRVLIYRFEEEGHGQVIAEASDPSMEVFNGLFFPASDIPEQARELYRTNWLRIIPNADYQPVPLVPKLRPDTQTPLDLSFATLRSVSPIHCQYMKNMGVLSSMSISLLKGDKLWGLISCGNRQPLHVPHELRTACQTIGQVLSLQISAMEALEVSRQREEKLEALALLNQAMIDSPQNVFDGLANQPQVLMALANAGGIAIIEDKQLHRYGNCPEPEEIRALHKWLQERGEPVFASHHLASVYPPAAHYQQVASGVLAMSLPKPVDNGVLWFRPEVKENINWSGDPRKPLDLENSDAGLRLRPRTSFEIWKVEMAGISTKWSHGDLFAANDLRRSALENDLARQVRREQEAVRARDELVAVVSHDLRNPMTVISMLCGMMQKAFSSDGPHTSRRISTAIDTMQQAAGRMNTLLEDLLDTSKIDAGRYTIAPQKLDVAQMFEEAQSLLAPLALDKDISISFEADPDLSIHADPERLFQVLSNLVGNAIKFTPRLGTVDVYAKSVGDDIVFTVRDSGEGIPKDHLPHVFDRYWTVKEGNPTGTGLGLYITQGIVEAHGGQIVAESEPGQGSEFRFTVPRLD

SEQ ID NO: 85 - protein, 847 aa, Pseudomonas putida
MTYNPQVNLTNCDREPIQIPGSIQPHGCLLACDASATVVLRHSVNAPQMLGVANDINGQKLHAVLGDEVTHTLRNALARTRDASRPALSFGVTLPNGAAVDIAAHLYKGTAILEFEPAGASIAEPIELARTLIAQLREIDQTHKLFRDAARFVRAVLGYDRVMIYQLGADGAGKVVAESKRSDLESFMGQYFPASDIPQQARALYLRNPIRVISDAQFNTVAINPVLDPSGEPLDLSYAHLRSVSPIHCEYLCNMGVGASMSISVIVNGELWGMIACHHYAPRTLAMGQRVAAEMFGEFFSLHIETLRSRQKLEAAVRIHKALDSLLRDANQAADIDGFFHARLPRLMSLIPCDGIGMSLLGRWSCAGLAPPQTAVPDLLRLADMVSEGRIWASNRLSTVLPSAQAYFNDVSGVLIIPMSQHPRDYLIFFRKEVVETLDWAGDPNKTYDSGALGDRLTPRKSFAIWKETVHQQSLPWTEQDRQFGDAIRTAIVEVVLHNSELLASERAKADVRQRMLNEELNHRVKNILSLIGALVAHPTPESQTLQDYVATLKGRIQALSLAHDQVVRGDGGGRLAKLLEAELSPYRTAADVIELQGPNVILDARAYSVMALVLHELATNAAKYGALSRAGGKLSVSWAIDASNACAISWREMGGPTVRPPSRSGFGTVLIDRSIPFDLGGTSAVEYHPEGLQGFFRIPAKHLSVAEAAETALPATPLARANGAFAARSGLCVLILEDQLVIAVGLEQILNDAQIKDVITASSEDQAMQLLGSHKPDAAILDVNLGTGTSISVADELVRRQVPFLFATGYGDGISIPEHLQHVPVARKPYDANAILASLQSLLELG

SEQ ID NO: 86 - protein, 748 aa, Pseudomonas putida
MTADNSLADAMERCAQEPIQVPGSIQPHGFLLVLDATDLRVLQASENVEHWLGLPARELIGCHFADLVHEGFDLHAHLTRLPEDEVFPFHIGDVRLRQGAPISALLHMLVHCHDQVLIAEFEPPRLPADLVGQGDYYPLVRSFVASLQVASSIEDLLQQTVLQLKRITGFGRVKAYRFDAEGNGQVLAEVVDPGYPSYAGLCFPAADIPRQARELYRVNRIRVIEDANYQPSPLLPATNPRTGKPLDMSFAALRSVSPVHLQYMRNMGTLASMSLSIVVDGQLWGLISCHHQQPRPVDLRTRTACELLASVLSLQIESRESHASTRKLLTLRQHIVRMISSMADHDSVSDGLRDLPEVLLAFADAQGAAVISAERCDLIGQTPPEAQVTALVHWLGQRDEDKVFHSDNLRRDITELPELANHAGGVLAVAISQIHSHYLLWFRPEQIRTVNWAGQPTKQVGPQGNLDPRHSFERWQEEQRGYSQAWDPLVIEGVIELRAAVLGIVLRKAEELAQLAGELRRSNKELEAFSYSVSHDLRAPLRHIAGYTELLGEIEGQGLSERGKRFLQHIGEAAHFAGSLVDNLLNFSQMGRSALRLSDVDLNALVEAIRSELAPDYEGRAIVWDIAPLPKVIGDPAFINMALHNLIANAIKYTRGRTPARIEISAVQHPEETEVCIRDNGVGFDMAYANKLFGVFQRLHRMEDFEGTGIGLASVRRIIERHDGRVWATGQVDQGASFHFTLPRNTAT

SEQ ID NO: 87 - protein, 755 aa, Pseudomonas putida
MTGAFSIMTADNSLADAMERCAQEPIQVPGSIQPHGFLLVLDATDLRVLQASENVEHWLGLPARELIGCHFADLVHEGFDLHAHLTRLPEDEVFPFHIGDVRLRQGAPISALLHMLVHCHDQVLIAEFEPPRLPADLVGQGDYYPLVRSFVASLQVASSIEDLLQQTVLQLKRITGFGRVKAYRFDAEGNGQVLAEVVDPGYPSYAGLCFPAADIPRQARELYRVNRIRVIEDANYQPSPLLPATNPRTGKPLDMSFAALRSVSPVHLQYMRNMGTLASMSLSIVVDGQLWGLISCHHQQPRPVDLRTRTACELLASVLSLQIESRESHASTRKLLTLRQHIVRMISSMADHDSVSDGLRDLPEVLLAFADAQGAAVISAERCDLIGQTPPEAQVTALVHWLGQRDEDKVFHSDNLRRDITELPELANHAGGVLAVAISQIHSHYLLWFRPEQIRTVNWAGQPTKQVGPQGNLDPRHSFERWQEEQRGYSQAWDPLVIEGVIELRAAVLGIVLRKAEELAQLAGELRRSNKELEAFSYSVSHDLRAPLRHIAGYTELLGEIEGQGLSERGKRFLQHIGEAAHFAGSLVDNLLNFSQMGRSALRLSDVDLNALVEAIRSELAPDYEGRAIVWDIAPLPKVIGDPAFINMALHNLIANAIKYTRGRTPARIEISAVQHPEETEVCIRDNGVGFDMAYANKLFGVFQRLHRMEDFEGTGIGLASVRRIIERHDGRVWATGQVDQGASFHFTLPRNTAT

SEQ ID NO: 88 - protein, 744 aa, Pseudomonas syringae
MSQLDKDAFEVLLANCADEPIQFPGAIQPHGLLFTLKEPELTILQVSANVQSVLGKVPDQLAGQTLDCVLGAGWAEVIRSTSANDSLVDVPRLLMSVEGVEFEALLHRSQEALVLELEIQDKAAQAISYSERTGNMGRMLRQLHAAADLQTLYEVSVREIQRMTGYDRVLIYRFEEEGHGQVIAEASAPAMELFNGLFFPASDIPEQARELYRRNWLRIIPDANYTPVPLVPQLRPDTQQQLDLSFSTLRSVSPIHCQYMKNMGVLSSMSVSLIQGGKLWGLISCGHRTPLYVSHELRSACQAIGQVLSLQISAMEALEVSRQRETKIQTLQQLHQMMATSDTDVFDGLAQQPQLLMDLVGATGVAIIEDRQTHCYGNCPEPSDIRALHTWMMAGGEPVYASHHLSSVYPPGEAYQTLASGVLAMSLPKPVDNGVIWFRPEVKQSVQWSGDPNKPLNLDASDNTLRLQPRTSFEIWKVEMTGIATKWSHGDVFAANDLRRSALENDLARQVSKEQQAVRARDELVAVVSHDLRNPMTVISMLCGMMQKSFSSDGPHTSRRISRQSTHAASCQPHERVARDLLDTSKIEAGRTPSRRSRWKSARYSKRPIRCSPRWRMDKSIEISFNAEPDIKVNADPERLFQVLSNLIGNAIKFTPKLGRIGVAAMSNGDEVVFTVRDSGEGIPPEQLPHIFERYWTVKEGNPTGTGLGLYISQGIIKAHGGELAAQSQVGHGSEFRFTVPIAH

SEQ ID NO: 89 - protein, 993 aa, Pseudomonas syringae
MIEHTLDANPDAALEAALAECAREPIRIPGAIQPHGVLLSVAGDPLCIEQVSANCAKSLGLESAELLGQPLSILLSAAHSMLINQAYSQPAMPNSDPIRLTVRAVDYNASLSRAGDVLIIELEPFVEAAHEQSRIITRVLRNLQAATTLETLFDIGVHEIQALTGYDRVMIYRFEPEGHGKVVAQALTGPLPSYSGLNFPGSDIPAQARELYRLNWIRLIPDATYVPVALIPTLRPATGQPLDLSLSTLRSVSPVHCEYLKNMGVRSSMSISLLDGGELWGLITCSHPEPLLVSRELRDACAMIGQLLSVKISAIVATHIQREREEKVVLLGQLADAMNRADHEILHGLVSRPQLLQALTQADGAAVLIDDQVHLFGQCPTSEEVRALYQWIRDTGLTRQRSKERATGLQGLGVFHTDSMQRERPESAAYRETASGVIAFTLPKPVDNAVMWFRSQLASTMNWSGNPAHHVSTRAAGSASHGLRPRQSFDVWKQEVTGIARPWSRADLYGAEDIRRSALESDLERQVQREQEAVRLRDELVAVVSHDLRNPMSIIIMQCGMMQRWAVDDTNFENRNIRRALGTIEKATTRMNSLLEDLLDTAQIEAGRYQLSRLALSVTSLLEEACSLLVMLTTEKNIELNCTSAQGLVIDADPERIFQVLSNLVGNAIKFTPKGGRINIDAVADGDDVLFRVSDDGIGIPAQHLPYIFQRYWSVKEGNPRGNGLGLYICQGIITAHGGRLWADSSLDSGSVFSFTLPMHQGQDTIGESTFLKQSGTTHRLAQSISSKLERQQLEDRLTRAGLLNELNHRVKNTLATVQAIASLTVNSSTSLDSFRKSFDARLFALSQARAEWMSTELADLLAQLQDVNGGQHRITFTGDPVRLEPRISLTLSMVLHKLMANALQHGALSSPAGQVTVASTLNSHHNPPTLSIDWLETEGPPVVASNVKGFGLRLIRRSIERELKGKVDIKFASTGVSWSMLIPWPEKPESSL

SEQ ID NO: 90 - protein, 745 aa, Pseudomonas syringae
MSQLDKDAFEVLLANCADEPIQFPGAIQPHGLLFTLAEPELTILQVSANVQTVLGHVPEQLLGKGLDCVLGAGWAEVIRSASAHDSFIDAQRLLMSINGIEFEALLHRHQGVLVLELEIQGKDAQSVSYSERTGNMGRMLRQLHAASDLQTLYEVSVREIQKMTGYDRVLIYRFEEEGHGQVIAEASAPSMELFNGLFFPASDIPEQARELYRRNWLRIIPDADYIPVPLVPQLRPDTQQQLDLSFSTLRSVSPIHCQYMKNMGVLSSMSVSLIQSGKLWGLISCGNRTPLYVSHELRSACQAIGQVLSLQISAMEALEISRQREAKVRALEQLNLAMAGSEENVFDGLAQQPQLLMDLVGATGVAIIEDRQTHCFGICPEPSDIRALHAWMIAGGEPVYASHHLSSVYAPAEAYQPVASGVLAMSLPKPVDNGVIWFRPEVKETVQWSGDPKKPLNMESSAGGMRLRPRTSFEIWKVEMTGIATKWSYGDVFAANDLRRSALENDLARQVRREQQAVRARDELVAVVSHDLRNPMTVISMLCGMMQKSFSSDGPHTSRRISTAIDTMQQAASRMNVLLEDLLDTSKIEAGRYTITPQPLEVSQIFEEAYTLLAPLAMDKSIEISFNAEPDLKVQADPERLFQVLSNLIGNAIKFTPKMGTIGVAAMSNGTEIVFTVRDSGEGIPPEQLPHIFERYWTVKEGNPTGTGLGLYISQGIIKAHGGELAAQSQVGEGSEFRFTVPMAV

SEQ ID NO: 91 - protein, 1003 aa, Pseudomonas syringae
MEFTQLIKDMLDAKPDAALEAALAECAREPIRVPGAIQPHGVLLSVAGDPLCIEQVSANCATEFGMAADELLGKPLSWLLSPEQSALIDHAYGHPAAPHIDPIKLTIGTAHYSASLQRADDVLIIELEPFVETGHGQSRIITRVLRNLQAATTLETLFDISVHEIQALTGYDRVMIYRFEPEGHGQVVAQALTGPLPSYSGLNFPGSDIPAQARELYRLNWIRVIPDATYVPVPLIPTLRPATGQPLDLGFSTLRSVSPVHCEYLKNMGVRSSMSISLLDGGELWGLVACGHPEPLRVSRELRDACAMIGQLLSVKISAIVATNIQREREEKVVLLGQLADAMSRANHEVLDGLVSRPELLMSLTLADGAAVLIDDQVYLFGTCPSIEQVRELYTWIRDTGLASQRSRQRATGLQGLGVFHTNSMQRELADSAVYRDIASGVIAFTLPKPIDNAVMWFRAQLTSTMNWSGNPTHHVSTRPESSASHRLHPRQSFDVWEQEVTGIASPWSRADLYGAEDIRRSALESDLERQVQREQEAVRLRDELVAVVSHDLRNPMSIIIMQCGMMQSWAVGDTHFENRNIRRALGTIEKATTRMNSLLEDLLDTAQIEAGRYQLSRLPLSVTSLLEEACSLLVMLTTEKNIELNCTAAQGLVIDADPERIFQVLSNLVGNAIKFTPKGGRINIDAVADQNEVLFRVSDDGIGIPAEHLPFIFQRYWSVKEGNPRGNGLGLYICQGIITAHGGRLWADSSLDSGSVFSFTLPVHQGTDSIGETTFLKQSGTTHRLAQSISSKLERQQLEDRLTRAGLLNELNHRVKNTLATVQAIASLTVNSSASLESFHKSFGARLFALSQAHDALARAEWISTELVDLIEQLQEQDSGAHRISFEGDPVTLEPRFSLTLSMVLHELMANALQHGALSSASGQVTVTSTLTAEHTPPTLKIEWKETGGPPVVATTVKGFGLRLIRRSIERELKGQADIQFARTGIIWSMLIPWPDKPESRL

SEQ ID NO: 92 - protein, 745 aa, Pseudomonas syringae
MSQLDKDAFEVLLANCADEPIQFPGAIQPHGLLFTLKEPELTILQVSANVQSVLGKVPDQLAGQTLDCVLGAGWAEVIRSTSANDSLVDVPRLLMSVEGVEFEALLHRSQEALVLELEIQDKAAQAISYSERTGNMGRMLRQLHAAADLQTLYEVSVREIQRMTGYDRVLIYRFEEEGHGQVIAEASAPAMELFNGLFFPASDIPEQARELYRRNWLRIIPDANYTPVPLVPQLRPDTQQQLDLSFSTLRSVSPIHCQYMKNMGVLSSMSVSLIQGGKLWGLISCGHRTPLYVSHELRSACQAIGQVLSLQISAMEALEVSRQRETKIQTLQQLHQMMATSDTDVFDGLAQQPQLLMDLVGATGVAIIEDRQTHCYGNCPEPSDIRALHTWMMAGGEPVYASHHLSSVYPPGEAYQTLASGVLAMSLPKPVDNGVIWFRPEVKQSVQWSGDPNKPLNLDASDNTLRLQPRTSFEIWKVEMTGIATKWSHGDVFAANDLRRSALENDLARQVSKEQQAVRARDELVAVVSHDLRNPMTVISMLCGMMQKSFSSDGPHTSRRISTAIDTMQQAASRMNVLLEDLLDTSKIEAGRYTITPQPLEVSQIFEEAYTLLAPLAMDKSIEISFNAEPDIKVNADPERLFQVLSNLIGNAIKFTPKLGRIGVAAMSNGDEVVFTVRDSGEGIPPEQLPHIFERYWTVKEGNPTGTGLGLYISQGIIKAHGGELAAQSQVGHGSEFRFTVPIAH

SEQ ID NO: 93 - protein, 884 aa, Rhodospirillum centenum
VPDRTTDDFGPFTEQIRGTIDGMGTAEFDALPVGAIQVDGSGVIHRYNRTESRLSGRIPERVIGRNFFTEVAPCTNIPAFSGRFMDGVTSGTLDARFDFVFDFQMAPVRVQIRMQNAGVPDRYWIFVRKLEDLRPPGPAPEAPAAHTASVTGEVVDFSVCEQEDIRRVGAIQPWGAVLAVDPRDWTVCAASDNAQALLDCARPPLGRPLGEVLDAGPLAALRDWLPDRTSRSWRGEMARGRRIDIRAHRSGGCVVLDLEPLTARPGEAPVCSLLAAVEADVAVIRQASSLTGLAQACARSVRVLTGFERAIVYRFDADWHGEVIAEDKVEDWPQSFAGLHFPASDIPRQARELYSQSLSRHVPDRDYVPVPVHRIEGTEPLDLSFSRHRSLSPVHLQYLRNMGVTASMSFSILVEGRLWGMVAAHHRQPHHVAIPRRSAAMTVVEAVALSIAAVERAEAMRGRQVDHAVLTALMVQMASSDAVEPALTQQATRLTDLFGATGAALSIDGHLLTVGDWPPPAEVAALRAWLEPRWGSAGLFRTSSLSSVFPDATAYRQKASGCLALRLSGGDFVMWTRPEEPRQITWGGDPAKALGAAGQRPMPRISFDRWVEERRGHAAPWPTWADEIATSLRHAISDMMLRHLRHVKELSDQLAASNEAKSRFLANMSHELRTPLNAIIGFSDLMMSGMAGTLPPRIQDYVQSIHASGEHLLRMVVNDVLDLSRIEAGRMELSPESLDAGILAAECVGMLLPRAVRGEVLLEVQAESPLPLTADALRLRQILLNIIGNAVKFTPPGGRVDVRARALAGGGAVFTVRDTGPGMTPEEVLTAMEPFRQVAQTRAAVEGTGLGLPIAKSLVDLHAGNLAIETAPGLGTTVTIEIGA

SEQ ID NO: 94 - protein, 855 aa, Rhizobium leguminosarum
MSGTHEPVDLTNCDREPIHQLGSVQPFGFLLAVSSDWIVIRASANLAEFLGVTEANALGRPVISLISPEALHAIRNKLTTLRGSDVVERIFGIALTPDQNSFDLAVHLNEGQVIIEGERCQEDRHDAASLSMRSMMSRLDHTETLEAFFREGARQARALTGFDRVMVYRFDESGSGEVVAEAARAGIGSFLGLHYPASDIPVQARALYLRNLFRIIADVDAVPVPILPPLDEHGQPLDLSMSVLRSVSPIHIEYLKNMGVGASLSISIVVDGKLWGLFACHHYGPRLPSAQSRSTAELFGQMFASRLESRERRLALDYETKARRIADRLLTSVADNASLLDDPAWLIEALADAIPADGIGVWINGRLALAGIGPDERSFAALVRHLNRNAAGRIYAVDRLAETYPDLEVDDAVAGMLAIPISRSPRDYVVLFRQELVRTVRWGGDPHKPVEYGPNGPRLTPRKSFEAWSELVRGRSLPFTEAERRVAETIRVTLIEVVLRLTDEVSMARQTANERQELLIAELNHRVRNILSLITGIIRQSQATSVSLGDYIRQLEGRIQSLARAHDQITRDHWAPASLRQLLLAETAAYLGKNAQRIQMGGEDVLLEPQAFSTAALVFHELMTNSAKYGSLSGTGSGTVQLRWHRDDEGNLRIGWREKDGPPVVEPKRHGFGSTIIRRSIPYDLGGKAEVRYVEDGLEADFSIPARHVVGPTSERSNPLPVGATGRKTIPDDQPLSGLNVLLVENNLIIAMDGEDILRRLGADVATAPSVTEAMEILAGQSFDLALLDVNLGDETSFGIADRLAADGVPFVFATGYGEGIAQANSHSDAPVLQKPYTMEGVTDILARVPLPRRE

SEQ ID NO: 95 - protein, 850 aa, Agrobacterium tumefaciens
MASTDYHVDLTNCDREPIHIPGYIQPHGCLIACDNAMRMVLRHSENCGELLGLEGDLNGRTAEDVLGKKLVHDLRNALTVTGRTTRPAMLPAMETSDGRSFDISLHRYKSTTIIEFEPSGSDAQPLGTARKMVDRIREADSVESLISRTTRLVKATLGYDRVMIYRFQEDGAGKVVSEAKQPELESFLGQYFPASDIPQQARALYLKNTLRIISDASGTRIPVLPAVDVSGEPLDLSYAHLRSVSPIHCEYLRNMGVAASMSISVIVDGALWGLIACHHYSPRVLSMPVRIAAEMFGEFFSMHLQVLKQKRRLDTINHAHAALDRFLRLAAHHANIEELLVDSFQDFADLMPCDGVGLWVGNNWHGHGATPPHDAIPRLARFVASASEGRVWATHALSQAIPEAEIYAGTAAGMLAIPLSQVKSDYLLFFRKEIVQNLNWAGNPEKSYETGPMGDRLTPRKSFAIWKETVRLQAQPWSEADREIAEAARIALVEVAFHHSELMAGERERAEVRQRMLNEELNHRVKNVLAIIKSLVGNPSQEGKTLQEYVTALKGRIQALSFAHDQIIRGEGGGALRDLLEAELSPHRSPETTVKLEGPQITLDSRAFSVMALVLHELATNAAKYGALSQNGGQLHVRWDVNENRDCEISWRETLLTTLPAPSRAGFGTALISRSIPYDLGGRSTIRYLPNGLEAEILLPFRHVSSVSAAFETKTEAETLPQPRRYNREEPLKVLLVEDQMLIAMDVENMLEDNGIKAIETATSSAMAIEKLKTYLPDVAILDINLGSDTSIPVARELHRRGIPFLFATGYADGSMVPDEFGAVPVIRKPYDEDALMAGIGVLVGDTERV

SEQ ID NO: 96 - protein, 724 aa, Bradyrhizobium sp.
MPVPLTTPAFGHATLANCEREQIHLAGSIQPHGILLAVKEPDNVVIQASINAAEFLNTNSVVGRPLRDLGGDLALQILPHLNGPLHLAPMTLRCTVGSPPRRVDCTVHRPSNGGLIVELEPATKTTNVAPALDGAFHRITSSSSLIGLCDETATIFREITGYDRVMVYRFDEEGHGEVLSERRRPDLEAFLGNRYPASDIPQIARRLYERNRVRLLVDVNYTPVPLQPRISPLNGRDLDMSLSCLRSMSPIHQKYLQNMGVGATLVCSLMVSGRLWGLIACHHYEPRFVPFDIRAAGEALAETCAIRIAALESFAQSQSELVVRRLEQRLVEAVSRDGEWQAALFDGSQSLLQPLGASGAALLFEGQVMTAGDVPSTQRIRDLATWLDRRRKAPDAPPQGLTVTASLTLDDPSFADIRSIASGLIAAPLSASEGEYLLWFRPEQVRTVTWGGDPLKAVIIGDDPSDLSPRRSFAQWHQLVEGKSEPWSPAELASARLVSETVADVALQLRSVRMVIAQDQLATISAQVLRSEQPVIIADVEGRILLLNEAFEQQLRASHPHIPHLRDLGAYCTAPAEFRANLDDLMRNKRSWRGELTLTGGATPQRPLMVRADPVIAPHDRVLGFVLIFSDLTERKTAEAARARFQEEIDGARRPSLRLDQSASLIYKELAASTVENAQLAALEVTHGAEAGSMPEMLESIRNSTARTLGILEHLVWYRSQSEE

SEQ ID NO: 97 - protein, 731 aa, Rhodopseudomonas palustris
VAGHASGSPAFGTADLSNCEREEIHLAGSIQPHGALLVVSEPDHRIIQASANAAEFLNLGSVLGVPLAEIDGDLLIKILPHLDPTAEGMPVAVRCRIGNPSTEYDGLMHRPPEGGLIIELERAGPPIDLSGTLAPALERIRTAGSLRALCDDTALLFQQCTGYDRVMVYRFDEQGHGEVFSERHVPGLESYFGNRYPSSDIPQMARRLYERQRVRVLVDVSYQPVPLEPRLSPLTGRDLDMSGCFLRSMSPIHLQYLKNMGVRATLVVSLVVGGKLWGLVACHHYLPRFIHFELRAICELLAEAIATRITALESFAQSQSELFVQRLEQRMIEAITREGDWRAAIFDTSQSILQPLHADGCALVYEDQIRTIGDVPSTQDVREIAGWLDRQPRAAVTSTASLGLDVPELAHLTRMASGVVAAPISDHRGEFLMWFRPERVHTVTWGGDPKKPFTMGDTPADLSPRRSFAKWHQVVEGTSDPWTAADLAAARTIGQTVADIVLQFRAVRTLIAREQYEQFSSQVHASMQPVLITDAEGRILLMNDSFRDMLPAGSPSAVHLDDLAGFFVESNDFLRNVAELIDHGRGWRGEVLLRGAGNRPLPLAVRADPVTRTEDQSLGFVLIFSDATDRRTADAARTRFQEGILASARPGVRLDSKSDLLHEKLLSALVENAQLAALEITYGVETGRIAELLEGVRQSMLRTAEVLGHLVQHAARTAGSDSSSNGSQNKK

SEQ ID NO: 98 - protein, 758 aa, Rhodopseudomonas palustris
MTEGSVARQPDLSTCDDEPIHIPGAIQPHGLLLALAADMTIVAGSDNLPELTGLAIGALIGRSAADVFDSETHNRLTIALAEPGAAVGAPIAVGFTMRKDAGFVGSWHRHDQLVFLELEPPQRDVAEPQAFFRRTNSAIRRLQAAETLESACAAAAQEVREITGFDRVMIYRFASDFSGEVIAEDRCAEVESYLGLHFPASDIPAQARRLYTINPVRIIPDINYRPVPVTPDLNPVTGRPIDLSFAILRSVSPVHLEYMRNIGMHGTMSISILRGERLWGLIACHHRKPNYVDLDGRQACELVAQVLAWQIGVMEEQAITRQTLKGQAIQRSLINDIEQLHDHRAGLARNSEALLELMGASGLCLHSREGVITIGQTPPGPIIDQLAQLAGRSGGSELFQTDRLSTIIPEAGAFAEVASGVLAVPLSRTPPRRVMLWFRPEVAQTVYWAGNPDKSVTAESGRLRPRTSFAAWTEQTHGRAIAWQPHEVAAAVEIRDLIIDVILRNTEKLERINTQLARSNEELESFAHVASHDIKEPLRHIEAFAGLLADNIREMGDERLGVMVSGIEKSSRRLRNLINDLAEFSQLGRRSKPLSWVSLETVLNEVLADLQPRITEARAEIQADRLPFARCDHNQIRQVLQNLIANSLKYRDPARPCRIRIFAQPDDNGGRAEIGSAPAIRICVTDNGIGFDKKYIDQVFEPFQRLHGPDDYEGSGIGLAICRKIVQRHGGRVGVDTVPGQGSTFWFTLPVSDDHGQG

SEQ ID NO: 99 - protein, 775 aa, Rhodopseudomonas palustris
MSSRSDPGQPMASATDPSGRLALDLTECDREPIHIPGAIQPHGYLFVVSETDLRIASVSANVEDLLRQPPASLLNVPIAHYLTAASAARLTHALHGGDPAAINPIRLDVVTPDGERAFNGILHRHDSIVILELEPRDESRYTNEFFRSVRVAIRRLQTAADLPTACWIAASEVRRITGFDRIKVYQFAADWSGQVIAEDRDSGIPSLLDFHFPSSDIPAQSRALYTINPVRIIPDIGYRPSPLVPDINPRLGGPIDLSFSVLRSVSPTHLEYMVNMGMHAAMSISIVRDNRLWGMISCHNLTPRFVSYEVRQACELIAQVLTWQIGVLEEAEIVRHSVRMRAIQNRLLHELGDEQGLTAGLSRVSEEMLALMGASGFALCSFDGVAAFGRTPSDDEIQALASWLSHRESRGIFQTQQLSASFPEAEVYSDIASGLLAVPLGRASTTLMLWFRPEVAQTVTWGGDPHKPVQIGPRGRRLQTRASFEAWREEVRDRSRPWRSHEIVAAEEIRDLVVDVILGRAEELENANRELSRSNDELESFAYVAAHDLKEPLRHIEAFAGLLNDLLLPEARSRLSLMVNGIEASSRRLRALINDLAEYSRIGRQARPLQPVDLNQILTEVLSDLKPMLQDARAEVVSEPLPTVLCDGSQIRQLLQNLISNAVKYRDAERLPHVTIAATIDSPPPAAPAGANVRRARITIADNGIGFDEQYREQIFEPFQRLHGPDEYQGTGIGLAICRKIVHRHGGTISATSRVGEGSVFTFTLPLCDQDAAES

SEQ ID NO: 100 - protein, 770 aa, Rhodopseudomonas palustris
MHSGLDNSAELRVSDFDPITLAGGTRTEVLPGAIQPHAALLALAPADLTIVHAAGATASLLGAAAELLPGTAASTAFSSDQIARLQALATAERWIERPQHAFTLNAPDATPIDVIVHHASGLLVVELDPRREPAPENSLALVQSMIRRARPAPNLQGFCDAMAAELRSVTGFDRVMVYRFARDGSADVIAEARGPETSPFLGLRDPQPDISNQPGSISRIRVQPDVHAPAAPLWPAHSPRNGLALDLSFSATRSASPEHRLYLAQLGVAASLSLSLVVEGELWGLIVCHHATPRFLPYRMREACALFAEMASLQLETRLAADQLAARLRSTRIHEELVTRMSQESDLAEGLIRFYPNLLDFIPAAGVGLWIDGQFTGIGATPGPAQVAAMMGWLHGVPHDGVYHTDCLALAYPPAKAFAGCASGLLALSLSNTPHNYVLWFRPEVVRVVTWAGMPNKPVGVDAGAPRTPKGCASSWQESVRLHGEPWLDTDVDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGRKPPSGRLGLLGIRERLSLVGGSLEIESAPGKGTALYARIPL

SEQ ID NO: 101 - protein, 759 aa, Rhodopseudomonas palustris
MDEADSGGIVTARNVDLSSCDRELVQYPEAIQPHGAMLTVDEQSDRVLHASANCAAFIGKPPEAVIGAPIAAVLGAGWHELLGSLHRMPLDSGPVNIARESFLGSDQGWHLFAHRCGGLIILEFEKAEPEAAGTTSNLYSEVRADLAALQATEGVQAFFDLAVERIRAFTGYDRVMAYRFAEDGSGQVIAEARRDDLEPYLGLHYPATDIPAPARRLFALSWVRHLPDVGYTPVPLLAAKSPLVTGPVDMSFASLRSVSVMYTGYLKNMGVQSTLVMPLVKEGRLWGLISAMHHAAPRHISHQMRMAAEFLAHTLSLLMSAKEDAEQFERSSARKAAAEALTRLLDSEADIGAALHAAGALDLLSALIDAGGVVVQTGDEVATRGEAPAAAPLHELTSWLRERARPVFATDRLPNLDPAAQAVASQASGVLALRPLPDQPMLIAWLRPEQIEDVQWAGDPRKPVEISDADGMQRLRPRNSFALWKESVQGRAVPWRDDEKDAATRLAAAIAEIAAARKGRIERINRALDASHSELSRYTDVASAELKEHLRGIHHLTTSLRRRQGEVLDEEGRQQVATILKLTQRMDALVDALLDRSRGGSEAASETVDLEAVVDDALAPFARRIAEDRIEVRRPMRLGTAQGHREWIGEVFTNLIGNAIRYNDKPERWIEIGVEAGSPPRYYVRDNGIGIADTDQQLVFQMFHRVDQSEQKAEGAGVGLAMTRRIVAHHGGRIWVQSRLGEGATFYFTLAPDEERHDA

SEQ ID NO: 102 - protein, 845 aa, Rhodopseudomonas palustris
MPRKVDLTSCDREPIHIPGSIQPCGCLLACDAQAVRITRISENAGAFFGRETPRVGELLADYFGETEAHALRNALAQSSDPKRPALIFGWRDGLTGRTFDISLHRHDGTSIVEFEPAAADQADNPLRLTRQIIARTKELKSLEEMAARVPRYLQAMLGYHRVMMYRFADDGSGKVIGEAKRSDLESFLGQHFPASDIPQQARLLYLKNAIRVISDSRGISSRIVPERDASGAALDLSFAHLRSVSPIHLEYLRNMGVSASMSLSIIIDGTLWGLIACHHYEPRAVPMAQRVAAEMFADFFSLHFTAAHHQRRFQSSLRTRRTLDSLTSEMSFDASVDDFLRGNLKRIADLIPSDGVGLWMNGVWTAHGSTPPADALPSILHLLTGRAGNEIVATHALTDRIAAATDYAGAAAGMLAIPLSQVAGDYLLFFRKEQVQTLNWAGDPNKTYDTGPLGDRLTPRKSFSIWKEQVDGQSVPWSPDDRDTAATIQVGLREVLLRQSEILSAERKKAEVRQRVLNEELNHRVKNILALIKSLVNQPAGEGKSLEEFASALRGRIMALSFAHDQVVRSDGGGALLDLIQAELSPYPASQITLEGPDVGVDARAYSVLALVLHELATNAAKYGALSRSSGRLKVAWTVGDDGRCDIEWTESCGPPVRPPTRQGFGTVLLSRSIPFDLGGWSEVDYLPGGVVARLGIPGQFVTETLQRLSSVQASGQSTDSSALNIADASILLVEDQLVIALDAEDMLGAIGAKLVTSVASAEEALQTIAQQPPTLAILDVNLGNGSSLPVADELERLGIPFIFATGYGDTAMIPERMRGLPIVRKPYSIDSLRGALSAMLDDRE

SEQ ID NO: 103 - protein, 856 aa, Rhodospirillum rubrum
MDTVHSTCDQEPIHVPGLVQPHGFLVVLDSKSGRIAQVTPGIEAVAGVVAQRLIGEPLERVLDPRSAQRCRHRIARPEYPHLIDPFPVRAPGGQSFSAVAHATDQADLVELWSDDQETTVEGVFGRLPFAIGHASRAASIEDLCGRAAATVADLTGYERVMVYRFAENWEGEVIAETLNGPVESYKGQRFPASDIPAQARALYSRNLLRSIPDVHYRPLPLVGRSPDGRELDMTFCNLRSVSPVHLEYLRNMGVAASFSVSLVVDGRLWGLVACHDRVPRRLSLATMGACQVYAETIAQQVLRLDNTRRSRHRSRTGDLIDDISVLLGSGRSLAEALDYTLDDTLALFGASRAVISLDGRQWTAEGPLEGAPIQVPPHQRLLLSERLGGRLRLPAELAGSFVGGVLLPLSDQPDRDFLLLGRPETLRSIEWAGRPEKQPEITPEGGLKIHPRTSFSLWREEVRGRSVAFDPLDRETAETLSLFLAERLAKQRRQQAVVALEETRQRLRDLAECSSDWLWETTGDGTLALVSDRINGLGDLRPEELVGRKLVDLVGGGDSGGAPGVDADEIASAFDEGRAFHGLTVSLALLGRGQWWVRLSGVPQYDGRGQLLGFRGTGTDVTPFKRLQEERVRTQRLEALGRLAGGIAHEIGNVLQPVLTMAHYASKRLDDRDFLEAALADICEGGARAKDIVRSVLTFARQTPAERRPLVLAPALARSVAFAAKGHPGLEIITDIPDTAGEIAANSTELSQIVLNLVGNAADAMGGRGRVFVSLAEAPDLGRMVITIRDEGPGMTLQTQARVFEPFFTTKPEGSGTGMGLAVVHGLVEAWGGTIGLESAPGSGTKFVISFPINNP

SEQ ID NO: 104 - protein, 1016 aa, Rhodobacter sphaeroides
MRLPSLAARPTGPRRTGVPSRLRWTGSVRHIPTRGRMCWPAPPRPSRRSSNGSPLLWQPGGYDRPPPPCRSLPHVCQNFVVRGCLMTISGGTFDPSICEMEPIATPGAIQPHGALMTARADSGRVAHASVNLGEILGLPAASVLGAPIGEVIGRVNEILLREARRSGSETPETIGSFRRSDGQLLHLHAFQSGDYMCLDIEPVRDEDGRLPPGARQSVIETFSSAMTQVELCELAVHGLQLVLGYDRVMAYRFGADGHGEVIAERRRQDLEPYLGLHYPASDIPQIARALYLRQRVGAIADACYRPVPLLGHPELDDGKPLDLTHSSLRSVSPVHLDYMQNMNTAASLTIGLADGDRLWGMLVCHNTTPRIAGPEWRAAAGMIGQVVSLLLSRLGEVENAAETLARQSTLSTLVERLSTGDTLAAAFVAADQLILDLVGASAAVVRLAGQELHFGRTPPVDAMQKVLDSLGRPSPLEVLSLDDVTLRHPELPELLAAGSGILLLPLTSGDGDLIAWFRPEHVQTITWGGNPAEHGTWNPATQRMRPRASFDAWKETVTGRSLPWTSAERNCARELGEAIAAEMAQRTRAELARLRHYDPLTGLANRSYLQERLAQDGQSAAALLFIDLDRFKAVNDSMGHGVGDGLLIEVARSLVATVRPHDLVVRLGGDEFVVLCHRLDAAGIVSLAERLRQVLEQPFEVAGRKCHISASIGIAMADSIGDLDLVRAADIAMYAAKKNGGNRGELFRPSLYEETTQLVELDNDMRGAIESEQFHLVYQPIFALNPETERLVGFEALLRWDHPLHGALQPGIFIPLAERLGHIHAMGNWVLRRAILQLQAFRSAGPELDLKMNVNVSPLQLARPDFLARLADLLAQVPDLPRHALCLEITETSLSDEAVSEALISIRALGVRIAIDDFGTGFSSLACLRRLPVDVAKLDRAFLGGGHTAAQDHRFFAAVTGLVHAADLKVVQEGIETLDQLALVRAAGADFAQGFHLAAPLSIAAALGLIAASRKE

SEQ ID NO: 105 - protein, 931 aa, Rhodobacter sphaeroides
MTISGGTFDPSICEMEPIATPGAIQPHGALMTARADSGRVAHASVNLGEILGLPAASVLGAPIGEVIGRVNEILLREARRSGSETPETIGSFRRSDGQLLHLHAFQSGDYMCLDIEPVRDEDGRLPPGARQSVIETFSSAMTQVELCELAVHGLQLVLGYDRVMAYRFGADGHGEVIAERRRQDLEPYLGLHYPASDIPQIARALYLRQRVGAIADACYRPVPLLGHPELDDGKPLDLTHSSLRSVSPVHLDYMQNMNTAASLTIGLADGDRLWGMLVCHNTTPRIAGPEWRAAAGMIGQVVSLLLSRLGEVENAAETLARQSTLSTLVERLSTGDTLAAAFVAADQLILDLVGASAAVVRLAGQELHFGRTPPVDAMQKVLDSLGRPSPLEVLSLDDVTLRHPELPELLAAGSGILLLPLTSGDGDLIAWFRPEHVQTITWGGNPAEHGTWNPATQRMRPRASFDAWKETVTGRSLPWTSAERNCARELGEAIAAEMAQRTRAELARLRHYDPLTGLANRSYLQERLAQDGQSAAALLFIDLDRFKAVNDSMGHGVGDGLLIEVARSLVATVRPHDLVVRLGGDEFVVLCHRLDAAGIVSLAERLRQVLEQPFEVAGRKCHISASIGIAMADSIGDLDLVRAADIAMYAAKKNGGNRGELFRPSLYEETTQLVELDNDMRGAIESEQFHLVYQPIFALNPETERLVGFEALLRWDHPLHGALQPGIFIPLAERLGHIHAMGNWVLRRAILQLQAFRSAGPELDLKMNVNVSPLQLARPDFLARLADLLAQVPDLPRHALCLEITETSLSDEAVSEALISIRALGVRIAIDDFGTGFSSLACLRRLPVDVAKLDRAFLGGGHTAAQDHRFFAAVTGLVHAADLKVVQEGIETLDQLALVRAAGADFAQGFHLAAPLSIAAALGLIAASRKE

SEQ ID NO: 106 - protein, 765 aa, Tolypothrix sp.
MLQLIYNNFIVSLSPENSPENAAIAPFEVDLTNCDREPIHIPGSIQPHGMLLALTEPELTIVQVSRNTDEILGVAATEFINQPLSRLLDAQQIDFFRNCLAQEDLTLVNPIELTIAVGENARAFDGIIHRSDRLLILELEPVLHQKNYTFFNFYHLVKAALSKVQNASTLDELCQIIVKHVRQMNGFDRVMIYRFDENWHGTVIAEDKSAHLSPYLSLRYPASDIPKQARQLYRDNWLRLIPDVDYQPVALLPHHNPVTNQPTDLSHSVLRSVSPLHIEYLHNMGVKASMSISLLKNQKLWGLIACHHESPKYVPYEIRSACEFLGQMTSLELAAKEDSENTEYKMQLKAVQSKLVEYMAAANNFVDGLIGQEPNLLDLVNATGAAVCINGEYQTLGRTPQHREIEQLINWLSQHTQEEVFHTNCLSELLPEASEWKDVASGLMALSISKSQKSYLLWFRPEALQTVDWAGNPHKPVELADDGSLRLSPRKSFDLWKEIVQRQSLPWESYEIEAVWNFRSAIVGVVLRKADELAKMNVELQRSNDELDAFAYIASHDLKEPLRGIHHYSSFLIEDYGNRLDDEGIGRLRTLIRLTQRMENLIDSLLHFSRLGRVELGIQPTDLNDLVQRVIDVLSARIQETGATIRIPRPLPTIMCDRVQVSAIFTNLIANGIKYNDKPEIWVEIGYLEPITLYVRDNGIGIRDRHFESIFRIFKRLHGPTQYGGGTGAGLTIAKKVVERHGGKIWVESTYGEGSTFYFTLQEVK

SEQ ID NO: 107 - protein, 634 aa, Xanthomonas axonopodis
MNQPTEPLDMDVCAQEPIHIPGLIQPYGVLLVIEPADGRIVQASSTAADLLGVPMDALLGTPYTQVLELPDAQPFAVDDQPQHLLHADVRFPQRSAPTDHPWVAAWHLYPEQWLVEIEPRDARLMDVTLREALPLLRSIERDAGIDEAAVRAAKGLRSMIGFDRVMVYRFDEEWNGDVIAEARQPELEAYLGLHYPASDIPAQARALYLRNRVRQIADVRYQPSPIQPTLHPRLGTPVDLSDVSLRSVSPVHLEYLANMGVSATLVSSIVVNDALWGLISCHHYSPHFTSHAMRDATDAVTRALAGRIGALQAVGRARLESVLLTIREKLITDFNDAEHLTVDMLADMAPDLMDVVDADGVAIFHGNEISRHGSVPDAEALRRIREHLESEHHDALREDAVGALHVDAIGEVFPELADLAPLAAGFIFVPLMPQSRSALLWTRREQVQQVKWAGNPQLAKLQDIPNSRLSPRKSFDLWQQTVRGRARRWSPLHLESARSLRVLIELMERKRFQQDFTLLEASLSRLRDGVAIIERGAKGAAHRLMFVNPAFAELSQTEVADLIGCDILALLDDDAARGKVELLEEALRLGRAAYVTLPLRTRDGAPVYRQFHLEPLPSPSSITAHWLLQLRDPE

SEQ ID NO: 108 - protein, 634 aa, Xanthomonas campestris
MSTATNPLDLDVCAREPIHIPGLIQPYGVLLVIDPADGRIVQASTTAADLLGVPMAALLGMPYTQVLTLPEAQPFAVDDQPQHLMHAEVRFPQRATPPDSAWVAAWHLYPQQWLVEMEPRDARLLDVTLREAMPLLRSVERDPGIAEAAVRVAKGLRSLIGFDRVMIYRFDEEWNGDIIAEARKPELEAYLGLHYPASDIPAQARALYLRNRVRQIADVGYQPSPIQPTVHPQLGTPVDLSDVSLRSVSPVHLEYLANMGVTATLVASIVVNDALWGLISCHHYSPHFTNHAMRDVTDAVARTLAGRIGALQAVARARLESVLLTVREKLITDFNDAEHMTVELLDDMAPDLMDVVDADGVAIFHGNDISRHGTTPDVAALRRIRDHIESEHHDALREDAVGALHVDAIGEVFPELADLAPLAAGFIFVPLMPQSRSALLWTRREQIQQIKWAGNPQLAKLEDIPNSRLSPRKSFDLWQQTVRGRARRWSPLHLESARSLRVLIELMERKRFQQDFTLLEASLSRLRDGVAIIERGTANAAHRLLFVNTAFADVCGSDVAELIGRELQTLYASDAPRANVELLQDALRNGRAAYVTLPLQVSDGAPVYRQFHLEPLPSPSGVTAHWLLQLRDPE

SEQ ID NO: 109 - protein, 1280 aa, Aspergillus nidulans
MSELPSRSISPRDPSPGETPGRDPSTPSTDAGVGYSASQDAPSFGAYDRVYPIRSLVSLEPPATSEPSSNKSKSPLSPTSGARQFSIIDGHTWTRLRSDSRANSTDYSGGTGLSPESSEAPSSQRMSDSSSARPPSNTTGLRRGDDHTTFTPSSEDSHPQVQEPYELMTTRFRHVVTDDGHAVITGRTVDSFKACEDEPIHIPGAIQSFGALVAVREEPGEQMVVRIVSENSQDILGYSPNDLFSLPTLCDIFPEDQADNFLDHVDFVKEEGYDPSVDGPEVFILTVNQPNGSTIRVWCAIHTNPALNGLVICEFELEDDHVNPLTSSGHISPAVPTNTLDVVPTIEQMAGSTITINQPLRVLRRARRRKGEAAAMEVFSIVSQIQEQLARADNMEALLDTTSGIVKELTGFHRILVYQFDSEFNGKVVSELVDPTMSIDLFKGLHFPAADIPKQARDLYRINKVRLLYDRDHVTARLVCRALEDLETPLDMTHAYLRAMSPIHIKYLANMQIRSSMSISINSMNDLWGLISCHSYGPRGMRVSFPIRKMCRLIGDTVSRNIERLSYASRLQARKLINTVPTDANPSGYIVASSDDLLRLVDADYGALCIRGEVKILAKSPQSQEMLALLEYLKVRKYNSVLTSNHIVKDFQDLNYPPGFKDISGLLYVPLSTDGLDFIVFFRRGQLTEVKWGGNPNEAKFTEGHLEPRKSFQTWRETVLDRCRDWTESEVDTAAVLCLVYGKFIKVWRQQEAALESSSLTKLLLANSAHEVRTPLNAIVNYLEIALEGALDGETRDHLSKSYSASKSLIYVINDLLDLTNVEKGQSLIKDEPFDLPTTFSEATAMFESEAKRKGLNYKVLSQPGIPETVIGDQRRVRQSISNLISNAVQNTSSGGVTVEVWHAPGEGDTDKATVKIAVLDTGRGISSSTLELLFRELEQVSGEDDSHYYGGSEEGEESAPEAKASKDKAVLGLGLALVARIVRNMHGQLTVRSEEGKGSRFQISLQFPIPEGSDTKSPTAEHRPVATGDSAAPFSTGDDVILVDSTTGSKRNSQDSLTRPDVPRKSEPEDTAPADGAGEQASGESEAQTRPKKTGESTASTSHEQSETARSRPSGPSSGPSAPERRPLRVLVAEDDPINAKIIEKRLEKLGHTVQRTVNGEECANAYSAESTQWDVVLMDIQMPILDGIESTKRIRQHESQSEVANLHIPIFAVSASLLEKDVQMYMDIGFDGWIMKPINFVRLNTLLAGIHEERARNGAVYQPGQWEKGGWFTPYTHS

SEQ ID NO: 110 - protein, 1221 aa, Botryotinia fuckeliana
MSNIDTVPSKSVVYPSVEEFQVERIFPIRNLVNGKGVDTESTSPNTDDVSSSNSSCRGPTSAREPYDKDDILNDSHSDGSSETNFLPPPYPPIPPDDQIRRLPKSPKHDYSTEVGGGEGSSEYEARKISQRSQLIPSKSGPPGIAPGEPVSTEERTFFKCEDEPIHIPGAIQQYGALIALRYNDQGDLMVRIASENAFKILKYTPEQLFSLNSFLDLLGVDVREDFIARVDHALRAVTKNPSADTKLDIFSMSVVAHTGLVNLWCAIHISKGTDDLIICEFEPFSDEMFFPDEPHNTKNDLPKFPTRTIDNDTVLEERLKSISSGSQPLRVLQIAKRKGRHAVGSLEVFNAMTQAQEQLAACTSVQKLQDVLVGLIFDLTGFHRVMFYRFDSAKNGCVEAELLNPKASDDIFRGLHFPASDIPKQALDLYKINRIRMLHDRDEKTARLVCRHQSDFEKPLDLTHAYLRAMSPLHLKYLSNMGVRSTMSVSIVINGDLWGLIACHGYGSHGTRVTLPMRELARNIGECASTNIERLLMRQRIEARRAPRQNPGKTPSGFIAASSDDLLKVFDADFGLLNIQDEARAIGRLRPYREALSILAYLQSRHFTEIFSTHNITKDLPKLKDSPAINSVAGILVIPLSTGGNDFLVFFRRGQLREVRWAGNPYEKIKPAKGQYLEPRSSFSRWTQTIKGTSKIWNADDFETASVLSLLYGRFIEIWRQKESTGLNRMTRLLLKNTSHEVRTPLNAVVNYLEMALEDKIESPTRELLEKAHRASRSLVYVIDDLLKLTKAETGPVTSVKDVFDLSATVSEVMSAFQKEAVRKNLDLTVTIQQGIPEMVRGDATRLRQVISNITSNAFQNSVVGGVKIDIKPIQIWPASTVISLTVQDVGIGMSESQLDELFQEFEQILDETDHSTIKKPAQPLIDVKETLGIGLAVVARYVRNSNGQIRVHSEVGKGTIFGIELPFEHAPAASNTQEIPIISTGRQIRPFSDSGSNYDESDKMNSTYTMSNFGSTPLATPIEEGSSATTSFFDLAMHSKEEYVEPPSVRRRSSLPFLNMIDLMSSKKSLSILIAEDNPINSKLLHKRLSKLSHKPEITAEGQSCYDYYTSGNNKVDVILMDLQMPLVDGTKATRMIRKFERDNLELHQIRRRVPIIAASASLLEEHRFDYIEAGFDGWIMKPINFSRLEFLLQGLNNPQLKQRSLYTPGMWELGGWFFA

SEQ ID NO: 111 - protein, 1342 aa, Cochliobolus heterostrophus
MSQSSDQIPQDGSSAPDNGHHQFSTVSPVAEEPSSPSAATDAIDFAATQPSQRSRASTTETTGPLSPSTSDRVFPIRSAISVDPSPTPKSQNAQGDYFHPFSRTNDPRLATDIRRASQGSLTSQSSHASQRAWAMRHGPGKTAQRGPQPIPSQLFNDMSSNKSNGSINDDSRSPSFKPEQAPSTKSGISSVDMGDLVTHRFRHVSTEGGHMIITGREGETLQRCEDEPIHLPGAVQGFGLLVALRDDPDGNLQVRIVSENSKRILGRTPKELFALESFTDILSEEQADNLLDHIDFVKDEESNVTSNGPEVFTMSIKIAGHTRTRKLWCAIHTNEANPGLVICEFELEEDPLYPLVPPNNNTPDLPEDTLSSQPTADEFLESTEIKSKPLRILRSARKRKGEAAAMEVFNIMSQVQEQLAAAPSLERFLKVLVGVVKELTGFHRVMIYQFDQSFNGRVVTELVDPRATKDLYKGLNFPASDIPKQARELYKINKVRMLYDRDLQTARLVCRTAEDLEVPLDLTHSYLRAMSPIHLKYLANMAVRSSMSISINAFGELWGLIACHTYGPRGMRVSFPIRKMCRMIGDSASRNIERLSYASRLQARKLINTVPTQHNPSGYIIASSDDLLKLFNADFGLLSIRDETKILGTLENSQESLAMLEYLRMRRIQAVMTSTDIATDFPDLRYPPGFHAIAGMLIVPLSVDGEDFIVFFRKGQLRQVKWAGNPYEKFIKEGTEGYLEPRKSFKTWSETVVGKCLEWTEEEIETASVLCLVYGKFIEVWRQKEAALQSSQLTRLLLANSAHEVRTPLNAIINYLEIALEGALDQETRENLSRSHSASKSLIYVINDLLDLTKTEEGGPLIKGELFDLKDTIREATDMFRNDAKRKNIEYQIIQHPGLPNHCIGDQRRIRQAISNITANAIQHTTQGCVKVEAYVAARTGRDHVDIEVAVSDTGAGMSQKKLDQLFNDLEQVQSEPASMLEDALIPDQKKLAEQGEKSTLGLGLAIVGRIIRNMNGQLRLRSEEGKGTRFVIQLPFEIPDSEADSVTTGGASPAGSVTPHAEESLPNVVSSTAGERTLIAPSLSRQGSAGEDDKQTSNVVVRKTSAGSLASKNSLRSFKTSSSQRSDVDRLIDAIQEPHLIGRGDTSPGSRSMRPTLTKRSSLDANASAAARRRSKSLEDFSNQTVVPPHQRIMQSTVPGKEAIPGSDAPVVALKVPDEGGSSPIGVRPSGNILGEVAEDKPIQPAAEPEPLSADNMHVLVAEDDPVNSRIVKKRLEKLGHHVHLTVNGEECASAYCDNSKDIDVVLMDMQMPIVDGLTSTKMIRSFEKSHSNMYSPRAAL

SEQ ID NO: 112 - protein, 1871 aa, Cryptococcus neoformans
MPDGSTSPREPANSTYSTHEPQSKRHSSPQSVAMPAAPRFHRQHTSSQDHGSSSTPISPAASSTGPLSPSIPPGSFVFPIRSVFQGMVHSDSSNGITEGHQQRKKDGLQRSSGSSSPLRSPALSDAHRFSTDAAGALHDEPDAGIQTIAQLLQQDRSAPLKEKGKHQPGVATFVGKAERDRNGSGGGETLKPSSPDASGHLGNSPITHSSSDSEHQKQQDVAKSSRSEEGTNDSPESSHGSGGTLKQATRTDLPAALQRSSTVKGKVSASGLTKPSPSNYRHFPSEHHSGQRERRFSTVNKVNPPSRNSSSHPVDASHPPNPELQHPVPRRNTRQQHTQDAEGNNRTSSHGSRTSLEVDESGMRSLISDMSGIVLLGEAGSWGSMGGSGVSGSKGTDGGTGTTGTLDSASIDSGHATGGRGQGDERQVTKASLAAKHGARQTSRQDSVRSFIQSQAGTTNLQDPNAPTLSPMPSGSPPAEGSQDATVSMEDSANNEKQREQQQEEGEAEQQGEEENGQVEQPVAASAEDAENPDEPAVTMRFEHVVTEEGHHIVAGREGRLRRCQDEPITTPGAVQGFGVLMVLEEDYETGNLEIRQVSEVNIFVIVMSKYQETILRDTLEYLPESYGGSNSVEDSGPSVFLLSGFGEPGSDAEEGVTEGGPETEVRSTASNAGGKRKEWTCWVAAHRPEHRGWNKVDEIGEPIPPPDWIILEFELERDVYNPLVHPSENAETSTAAANSNARSLSPDSTAASVSASGSNSNSNTLSASTRSGERTLDSLTSTLAGGRAGVSAGLGPGTASSDASPGDLGSSASDFTSVPKQEARMGLDGLEMHIPLEKILESTTNHASPLRALERMRGTTVNASNEARSRGRGRGRARGGRQRPIRTESGGTGTMDIFAVLGQINDQLVAAPDLDTFLKVAVGLMQDICRFHRVLIYQFDEQMNGLVVSELVEWGKTTDLYMGLRFPATDIPPQARELYKINKVRMLYDRSQTTARMVLRNKEDLDQPLDMTHCYLRAMSPIHLKYLGNMSVRSSMSISIMAFGQLWGLIACHSYGQHGMRVSFPVRQMLRLLSDSISRNIERLSYAQRLHTRKLISTIPDRSHPTGYIISNAGDLLQIFGADAGLLVIGDGCKLLGHSNEQGQAMLAIAEYLRIKRFDNLNASSSIQRDFPDLVLPRASDTIAGLLYVPLTAKAGQDFIVFLRKGQVREVQWAGKPYKDDKASEEASLEPRKSFKAWTETVTGCSRAWTDHQLESAGVLALIYGKFIQVWREKQTAMASNQLTAILLSNTSHAVRTPLSQIINTLELALAGNIDDDVRKMLENSHQASRALLFHVHDLLDLTRIETGNETAFNDPFDIRQSISDAVRLYQTEVARRGLEFRVNMAEDLPRYVVGDSRKIKTVISNLVANSVKFTEKGFIEVYCGIQRPFDGESSQTSLTESKEGNTITIEIVISDSGCGIPTVQLEEMFFTLEGAEPLQKNTGVGLGLAVVARIVEQLEGQLRAESEVGVGTRFYFNVPMVAHPSGRPGSRQSSHNSRNTNSSQLRTRTGSSGSKSDSVVSLRSDGSGVPEIESFVQDFGGSHLPAPVGDDDPRLLEAQERMSRLGTFPVTDSSYPVRATKVNTDDQHVKSPKPKKPRFTAIGSSERSTSRHNTTSSKTSSASQSPAFSRPSSNSVQGPKRNKKGPNGKTVMRIMVVEDDPINSQILQKRLKMDKHVVVAVTNGQEAVDQLEKDRDIDAILMDIQMPIMDGRTSAKEIRELEARTPQPDDIEPFKVDGRTPIFAVSASLYEDDRANLAENFDGWLLKPLDFSRVRAILEGLESSEKRGAEVYQQGNWERGGYLKAAPLPASSSASTPSTTQSSPCTSTS

SEQ ID NO: 113 - protein, 1469 aa, Gibberella moniliformis
MGQDLPNLRTSPSDATPTRTTRAASSAAPSEQNSIANSDPPFSPWSVGSDKQLGYHSAASDISGDRVFPIRSVISVDPNSSKIASEDYFPTLPERDGRSIPVHIPGAPRADTGSDLRRSDTVPANYHSRAHSERIDTLMRRKNTMSGPMSSIQLDANRHGSSTTPLQLDISTSDNETETEESGPTGHSVPAAAPSGHEADVSSAGQSNADVPLVTSRFTHVVTDDGHAVITGRDGVLQRCEDEPIHTPGAIQTFGALVALREENDGCFVARYISENSERMLGYTPKQLFQLKNFLDILTEEQQDNLLDHIDFIRDEDADPAINGPEVFSLSIRSPKRKSTKLWCAIHINPAHPDLIICEFELDEDAEYPLRPVDELTPDTPHDTLQSNPTLEEIEDSTEVLSKPLRILRSARKRRGEQGAMQVFDIMSQVQEQLSSAPNLEAFLKILVGIVKELTGFHRVMIYQFDSSFNGKVVTELVDTSMTRDLYKGLHFPASDIPRQARDLYKLNKVRLLYDRDQDTSRIVCRTKEDLDVPLDMSHSYLRAMSPIHIKYLKNMAVRSSMSISINAFNELWGLISCHSYGNHGMRVSFPIRKMCRLVGDTASRNIERLSYASRLQARKLINTAPTDKNPSGYIIASSEDLLKLFDADFGLLSIKGETKIMGLVEQSQEALAMLEYLRMRQLTSVVASQDVKEDFPDLRYPPGFQVVAGLLYVPLSVGGNDFIVFFRKGQIKEVKWAGNPYEKFVREGTAGYLEPRKSFKTWNETVVGKCREWNEEQVETAAVLCLVYGKFIEVWRQKEMALQNSKLTRLLLANSAHEVRTPLNAIINYLEIALEGSLDQETRENLARSHSASKSLIYVINDLLDLTKTEEGQNLVKDEVFDLASCIREATGPFLNDAKRKGIHYTVVQHPGLPQFVHGDERRIRQALSNVTANAVAHTHSGYVKVEVFVSEVKDRQAVVDFVIEDSGIGMSASQLDTLFRDLEQVSSEEAPMSGTKLEEMPREMRTLGLGLAVVARIVRNMDGQLRLKSEVGQGSRFVVQLPFLLSNECPSSHGNENLPTSVPTNKSTNSAESANTATSAPLSLTAAPEGEITLVDRVSSMTSAVEGGDASMKGSRASQRSMSSHGSHQSDADRLIDAISTPLSLNDREGSEYPLPASVRSGGSSMRPTSRGAVSLSGRSVSPPQSPVATKPHSEPGSTGVVDSKTPIRAVKIPDEYSDVPQRPQPSEHSRVLFEMKGNDRPVTKAATESITSGGTQMTESQHLEVLVAEDDPINMKILRKRLERVGHGVHHTANGEDCAAAYRERSKEFDVVLMDMQMPIVDGLTSTKMIRSMEASGEHQGHSSLANSNYRIPIFAVSASLVEREKQTYVDAGFDGWILKPIDFKRLNTLLAGISDEEVRKSCLYEPGQWERGGWFLSRAVLGGSVTSDETTPKAVPDAKDKDIGNTVAAEEAKAESDASEPAPST

SEQ ID NO: 114 - protein, 1525 aa, Gibberella zeae
MDVPHDKEGQDISQPEQKDNEEQQHNPSSTTLPSESYPPPPQSSTASSSTFRPSGPDVLPGLQTNTHNNNNATPTRTTRAASSAAPSEQNSVSNSETPFSPWSVSSDKQLGYHSAASDVSGDRVFPIRSVISVDPSSSKITNNDYFHALPQCDGRGIPVKVPSTSRADIGPDLRRSDTVPANYHSRAHSERIDALMRRKNTMSGPMSRIQLDANRHGSSTAPLELDISMSDNEADADADTETEESGVMGHASANVSAGGLEPDASSAGYSSADISHVTARFTHVVTDDGHAVITGRDGVLQRCEDEPIHAPGAVQTFGVLVALREENDGCFVARYVSENSVRMLGYTPKQLFQLKNFLDILTEEQQDNLLDHIDFIRDEDADPAINGPEVFSLSIRPPKCKSTKLWCAIHINPAHPDLIICEFELDDDVEYPLRPADEMTPDTPHDTLQSNPTLEEIEDSTEVLSKPLRILRSARKRRGEQGAMQVFDIMSQVQEQLSSATNLEAFLKVLVGIVKELTGFHRVMIYQFDSSFNGKVVTELVDTSMTRDLYKGLHFPASDIPRQARDLYKLNKNCLPNKRRPRHSARHEPLLSASHVAYSYHYLKNMAVRSSMSISINAFNELWGLISCHSYGNHGMRVSFPIRKMCRLVGDTASRNIERLSYASRLQARKLINTAPTDKNPSGYIIASSEDLLKLFDADFGLLSIKGETKLMGPVEQSQEALAMLEYLRMRQLTSVVASQDVSEDFPDLRYPPGFQVVAGLLYVPLSVGGSDFIVFFRKGQIKEVKWAGNPYEKFVREGTAGYLEPRKSFKTWHETVVGKCREWNEEQVETAAVLCLVYGKFIEVWRQKEKALQNSKLTRLLLANSAHEVRTPLNAIINYLEIALEGSLDQETRDNLARSHSASKSLIYVINDLLDLTKTEEGQNLVKDEVFDLASCIREATGPFLNDAKRKGIHYTIVQHPGLPQFVHGDERRIRQALSNVTANAFAHTHKGHVKVEVFVSEIRDQQAVVDFVIEDSGIGMSAGQLDTLFRDLEQVSSEDAPTSSSLDDMPREMRTLGLGLAVVARIVRNMDGQLRLKSEVGQGSRFVVQLPFLLSDQYSGSHLKSAPAGRGNQSFNSTSTASTAPDALRAAPEGEITLVDRASTMASAGDISLKGSGASQRSMGSHTSHSSRGSRGSHQSDADRLINAIQTPLSLNEREGTEFPIQGGRGSRSNSMRAESRGAISLDGRSASPSDQQPQSPVSTKPRSEPGSTEVMDSKTPIRAVKMPDDYTDMPQKPQPSEQSGVLFEMKTIDRPVAKAGTESVTSAGTQMTDQQHLQVLVAEDDPINMKILRKRLERVGHGVHHTVNGEDCAAAFRERSSEFDVVLMDMQMPIVDGLTSTKMIRSMEASADYHGHSALANTNHRIPVFAVSASLVEREKQKYIDAGFDGWILKPIDFKRLNTLLAGISDEEVRNSCLYESGQWERGGWFHPRSLVGGSEASDETTPRAEHDAKDKDIGETAIISEDAKETGGAGEAKPDND

SEQ ID NO: 115 - protein, 1536 aa, Neurospora crassa
METGMDHTQDTTPTAEGHGQLGNSYQTPDQLAANNIKVQDYIDNTALATDLHANDASNSSATADGGSSAITSPTNLSSWSASSDRQLGHGSVQDPEDRVFPIRSVISVDLAATPPVNDDIRARRRISLSEGYATSAGAGNTATPTRPHASTVPTAKSGAIDVESRPTVSQSQSSVSQPDGSSVFSSSSAGTMRHKRRMNAMTGSLSSVQADADRYGKGRPIELVLGDSSEEESDGGADGSGDGGDLGTIGASSSSGRESLDALPETHFAPRFKHIVTNEGHAVITGRDGQLQRCEDEPIHTPGAVQGFGLMVVIQEERDGRFIVRFVSENSKRIIGYTPQELFRMNNFLDIFTDEQSENLLDHIDFIRDEDSDPAINGPEVFSLSIRLPKAKTSVRLWCAIHVHPSRPELTICEFELDDDHDYPLRPPEEDLPDIPEDTLQSNPTTEELTESTAISSKPLRVLRSARRRRGEAGAMQVFDIMSQVQEQLANAPNLEKFLKILVGIVKELTGFHRVMIYQFDSSFNGKVVTELVDPMQTRDLYKGLHFPATDIPSQARELYKLNKVRLLYDRDVESARIVCRTPEDLETPLDMTHSYLRAMSPIHLKYLANMAVRSSMSISINAFGDLWGLVSCHSYGPKGMRVSFPIRKMCRLIGDTASRNIERLSYASRLQARKLINTVPTDKNPSGYIIASSDDLLKLFNADFGMLSIREETKILGKIEQSQEALAMLEYLRLRKFSSVVTSQDIKIDFPDLRYPPGFQVIAGLLYVPLSVGGNDFIVLFRKGQVREVKWAGNPHEKTIQAGSAAYLEPRKSFKVWYETVIGKSREWSEEEVETAAVLCLVYGKFIEVWRQKEAALRSSRLTRLLLANSAHEVRTPLNAIINYLEIALEGSLDQETRDNLARSHSASKSLIYVINDLLDLTKTEEGKDLVKDEVFDLLACIREATEPFRHDAKRKGITYEVIEHPGLPRFVHGDQRRVRQAVANVTANAVKHTSEGSVRVELYVAEVQDNRARIDIVVQDSGQGMSNAQLDALFRELEQVDTDIGSESSDDDNSQSGKALGLGLAVVARILRNMDGQLRLKSEVGKGSRFVIQLPFDLPEEETSRDTVGASSGNTAQLSLGSGTASASAASVTQMQDGEVMLVDRNNGSSWSVNNATGSLASKKSYDDNLSITSKGSGRSALSDADRLIDAIQNPLTLGEPEPESVARQRRNSRGPYYNPSSSLLGSSKGRSVSPGSRKRPDVPTRSVSSPNTKKDLPFEKPTTEVAPGPSEPAPAAQGVQYVTDSRVPIKPVKLPDEMFDKPVVPPQSTSKVLFEIKDAVADKAKAASSAVKEQQSVSSQQPAPPPAPAKEASTTNNKLQVLVAEDDPINVKVLRKRLEKAGYKVTHALNGEDCAAVYEDKPVVFDVVLMDMQMPIVDGLTSTKMIRAFEKTNRDGSGQQLSDIASDHGRVPIFAVSASLVEQEKDTYVDAGFDGWILKPIDFKRLETLLQGITDDKARNDALYVQGQWERGGWFEKKGVGNMGQEQEENHEQ

SEQ ID NO: 116 - protein, 1169 aa, Neurospora crassa
MDPMSQPIERVFPIRLSILESSAFLRNVSDADDLLSVVPVTQQLSNQHLSPPSSDGSRCEPLPSATDRQANPQDSSSAASSYNYTYPSSFNKGNGGDDSLLSETFEYALLADGSHGVIQKARRAFTTCDEEPIHIPGAIQSYGMLVALKLVDERVAGPSRYLPRICSENSAFVCHYQPSELLSLDSFYQVMPNFQRHLFDVQLRHIRQGYDSTKKEQEPVVFAFSFSDPDGRLIPCWCAAHYLGGDTDLFICEFELQDYSMHPLATPAMSDPGNPIDTLGSDHLDFATACSIQSKVQPAFPNPELISKGFDPSTSSVEVIGMATKIQTQFSEAATVPDLLETIVSIVKEVTRFHRVMVYQFDRDYNGTVVAELMDPKASNDVYRGLHFPASDIPPQARKLYMINKVRVLFDRSQRTSRLIGRDVSDMDVPLDLTHAYLRAMSPVHLKYLSNMGVRSSMSMSLESDGKLWGLIVCHSYGPAATRVPFSIRELSFFVGLAASTCLQKLLNSERLQAHRIIETLRGRGRPDECITSSSHELLNLFDCDCGFLVIEGEARTIGRLSSYIEAITLLKYLFFRGSRTILFSHNIGDDFKDLHFPSGFKAIAGVLYIPLSSTTDDCVVFYRKNQIREVHWAGRPSLAGKIGRLEPRNSFKKWTEVVDGTSKAWSIEHTNLAAMAQLLYGSFIQVWREKETAINDTRLKRLLLHDASHQVRNPLNAVINCLEIALEKHLDDGTKQVLTTSYTASKSLIYVIDDLLSLTGSITGSVPLLDEPFHLPNCLEEVLCPLRRLGQEKGIQLIMIPSTGPTQYVRGDPTSLQRSLSILVANAIQHTTSGQVVVKWYETAMNPENTVIHISITDTGPGFSERELDDMFQEFEQVPDEDFDEATSKPHAVRDNVLRVGVGLAFVARFVKQRNGQLKVKSTKGRGSTFTLEIPFAVSSHCSSIASRRRDASPLPVLTMPGPLTFGAGSSVPSDRSTFGTSRDSKPSPPIIRPGSSTADTSPRDFQTPSPHHYTVIVADDNMINVQILERRLTKLGHRVLVSRDGQECFNLFASNRSTVDFVLMDLNMPVVDGFASIRMIRDQEYSHPTPSRVVQCCGRTPIFAVSGMLRRGQEQQCKEAGFDGWMPKPVDMKRLVRCLAGGLDPNARRMCVYDEKRFELGGWFDAE

SEQ ID NO: 117 - protein, 1572 aa, Ustilago maydis
MSSPPQKANRRAPQASAPPTLSHTPTSSATAAASATASATPMQATPSSLRSPTVSQPFIYPMRSAVSIKPLKNDLSTSHPPDAPISAAKSASRPASAEGPKSSPTKFPTFKPPPSAPHASHQAHHPEEVHNVTDPATADITVPVNKDESLCDHPEHLTTTRFEHVKTDEGHMILTGRGGKLARCEDEPIHIPGAVQSFGCMIVVRISPDGEMLVRQASENSAAILGMSPSYLFSLPTFLDLFDDDQADLLWDNIDTLDQSSQDLAESGPTVFQLRGYDMASYDERVSRGVQRNRWNTWCGAHIPDRRNDGQAELTVVLEFELVDDLTNPISTSSPPATPLDDRESHSGNGPGLGLAAGWIRPDQPTSSRQDSSPVTIGTVLSSSNASSVGPRAGLEGLAYTPSPNELHESTHAIHKPLKALSRMRRNAEIKSQTRSRRPAVLPNAGGADGTGGILDLFGILSQVNDQLAAQADLNEFLKVLVGIIRDITLFSRVMIYQFDEAWNGQVVCELVDWNDSHDLYRGLHFPATDIPAQARALYKINKVRLLYDRDQPTARMICRDQADLDFPVDMTHAFIRAMSPIHIKYLTNMGVRSSMSVSITAFGELWGLISLHNYGAHGKRVSFPIRQLLRLIGESVSSNIERLSYTRRLSARKLINTLPTDQNPSGYIISNAEDLLTLFDADYGVIAVGNEAKILGPLNASQEVLAVTEFLRLKKFEHLVTSQDVHRDFPDMVLSTGLHVIAGLLVVPLSGSGVDFIAFLRKAQLRHVNWAGKPFKEGKEGEAILEPRKSFKVWSETVEGTCRAWKDEELETASVLCLVYGKFISVWRQREQALHYNQLNRLLLSNASHEVRTPLNHIINYLELALDSKLDEDTRENLSKSHLASKSLLFVINDLLDLTKQEIGNELFLQEPFDLAATVREAVEMHEWEAKRRKIDFSVTTNPDVCLVLGDKNRVRQVITNTVTNSVKYTRAGQIIVSMRKRNEDEREADLPDGCDMEVELVVSDTGEGIPQEKLEVIFREFEQVESVIAQPGRQDLSEPEGSEASLLRTEPSDSGLGLGLAIVARVVKNLGGQLRVDSQVGEGTSFTYYIPFCSAETTTPTEMPPIGSSGGSGTKRSSDTISMRRSTSMGSGSASSAGRSEIDSLVEAIQQPVLRDQATSEDVVARRRTAEGVSPGLIHGSKIVSAGSIHRPEYAAQRTRSFDSGSHPVEGSGIPVRSVKINPQALDANDRADRRPASSSAFLLSATTHARPVKPSHTSAAESFKAEVEQRFRDKVPQLAQATLPVDASKLRSCQMADKEATVSPTTRAKSGVEAPQNEAVSPDCGDVHMAKRSSDERRSSSSSSVAKRRLAVMRGLHKAPGGRGEKIAPLRVLVVEDDPINRMILKKRLGLDGHTTLLAVNGEEGVRQFEQDAKEIDVILMDLQMPICNGQEACIRIRDLEHKWAERGEQADRPASQILNGRVPILAVSATLVPQMRQEMVDIGMDGWLLKPIDFARLGALLKGLLHPEDRVANHWRSGYVWEKGGWLSEPAQRSVLVAPSAVSEMIGHSSSNASNANPLSPPLSSPSA

SEQ ID NO: 118 - protein, 920 aa, Nostoc sp.
MSPTAKPNSQVSLNQESVLRRITARIRQSLELEDIITATTAEVRALLGTDRVMIYKFHPDGSGQVIAESIYENRLPSLLGLNFPADDIPPQARELLVKSKVRSIVDVATGMIGQSPVHDLETGELISEDICYRPVDSCHVEYLTAMGVKSSVVAPIFCQDELWGLLVSHHSENRTVSEDELEAMQMIVDQLAVAIAQSHLLTQARKKAQKEAIINRIITLLHSLPTIVLKPALEAAVGAFAGVGGRLCLRNQAVESQHVVLRSLAECLIPGSNCVQLYTCGQQPITPEQTIYPLIEQYRVWQEHYTSHHDIWAIADIYQDSTLRSLQAVFQPTKIRGILIIPLEYRQQLLGYLSIFRNEIDTETLWAGRIDQDQRQMFPRVSFNLWRDAKKSQAQEWTSEEIELAKEIGQHFASAIQQYELYQQVQAFNENLEKQVQKRTLELRHTSEQQQAVFGVISKIRESLDTNTIFQITTKEACQLIKADRVSVYRFDNEWGGEFVGDFEATSPHWSNESKISINTVWNDTYLQNTQGGRYRYNETFAVDDIYKVGFTQCHVENLEQFQIYAFVLAPIFVGQKLWGLLATYQHSGPRQWKPSEVNFLTQIAAQLGIALQQAELLNQTQQQAQKLTQALHHLQQTQTQLIQTEKMSSLGQLVAGVAHEINNPVNFIYGNLSHVSEYAQNLLTMLELYQQELPNPSVEILEQADEIDLEFLAKDLPKTLSSMQIGVERIRQIVMSLRTFSRLDEAEMKAVNIHEGIDSTLLILQHRLKAKPETAGIKLTKKYAEIPLVECYAGQMNQVFMNVLSNAIDALEDCKETKSPNHNGEIIISTSFGQIRDSIQSIVIRIMDNGPGIPEDLRLRICDPFFTTKPVGKGTGLGLSISYKIVVDRHGGVFKCDSQLGSGTEFWIEIPIQQVNGNW

SEQ ID NO: 119 - protein, 1276 aa, Synechocystis sp.
MNPNRSLEDFLRNVINKFHRALTLRETLQVIVEEARIFLGVDRVKIYKFASDGSGEVLAEAVNRAALPSLLGLHFPVEDIPPQAREELGNQRKMIAVDVAHRRKKSHELSGRISPTEHSNGHYTTVDSCHIQYLLAMGVLSSLTVPVMQDQQLWGIMAVHHSKPRRFTEQEWETMALLSKEVSLAITQSQLSRQVHQQQVQEALVQRLETTVAQYGDRPETWQYALETVGQAVEADGAVLYIAPDLTGSVAQHYQWNLRFDWGNWLETSLWQELMRGQPSAAMEPMAAVQSTWEKPRPFTSVAPLPPTNCVPHGYTLGELEQRSDWIAPPESLSAENFQSFLIVPLAADQQWVGSLILLRKEKSLVKHWAGKRGIDRRNILPRLSFEAWEETQKLVPTWNRSERKLAQVASTQLYMAITQQFVTRLITQQTAYDPLTQLPNWIIFNRQLTLALLDALYEGKMVGVLVIAMDRFKRINESFGHKTGDGLLQEVADRLNQKLSPLAAYSPLLSRWHGDGFTILLTQISDNQEMIPLCERLLSTFQEPFFLQGQPIYLTASMGISTAPYDGETAESLLKFAEIALTRAKCQGKNTYQFYRPQDSAPMLDRLTLESDLRQALTNQEFVLYFQPQVALDTGKLLGVEALVRWQHPRLGQVAPDVFIPLAEELGLINHLGQWVLETACATHQHFFRETGRRLRMAVNISARQFQDEKWLNSVLECLKRTGMPPEDLELEITESLMMEDIKGTVVLLHRLREEGVQVAIDDFGTGYSSLSILKQLPIHRLKIDKSFVNDLLNEGADTAIIQYVIDLANGLNLETVAEGIESEAQLQRLQKMGCHLGQGYFLTRPLPAEAMMTYLYYPQILDFGPTPPLPKVALPETETEAGQGNVGDRPLPNSLNRENPWTEKLHDYVLLKERLQQRNVKEKLVLKIANKIRASLNINDILYSTVTEVRQFLNTDRVVLFKFNSQWSGQVVTESHNDFCRSIINDEIDDPCFKGHYLRLYREGRVRAVSDIEKADLADCHKELLRHYQVKANLVVPVVFNENLWGLLIAHECKTPRYWQEEDLQLLMELATQVAIAIHQGELYEQLETANIRLQQISSLDALTQVGNRYLFDSTLEREWQRLQRIREPLALLLCDVDFFKGFNDNYGHPAGDRCLKKIADAMAKVAKRPTDLVARYGGEEFAIILSETSLEGAINVTEALQVEVANLAIPHTVSGTGHVTLSIGIAVYTPERHINPNALVKAADLALYEAKAKGRNQWLAYEGSQLPHVDGEV

SEQ ID NO: 120 - protein, 1102 aa, Nostoc punctiforme
MTSNPEQNFLYSQEESLLRRITNRIRRSLELEEIITVTTAEVRSLLKTDRVMIYKFHADGNGQVIAESIYNNRLPSLLGLNFPADDIPLSARELFLKLRVRSVVNVDTQEIGQIHLRDLDNGETISEEIRYRSVDSCHIEYLTAMGVKSSVVAPILYQDQLWGLLVSHNSEARLISEYELEAVQMVVEQLSVAIAQSSLLTQVRKTAERETIINRIATLLHSLPTIVLQPALEAAIAAFNGVGGRLCIRNEAFDYYNGNLTSLTECLIPGNTCIKLFICGQQPVMPEQTIYPLIEQYSIWQEHYKSGKYDVWAISDLYNSPDLRSLQVAFQPTKIRGILTIPLQYRQQLLGYLSIFRNEVDTETLWAGQYDSDQRQLYPRRSFEVWRESKKAQAQKWTVEEIELARDIGKHFASAIQQYELQQQVQVFNENLEKQVKRRTVELQRTAEQEQAVFKVIAEIRESLDTDTIFQTTTKEVCQLIKADRVSVYRFDSNWGGEFVGDFEAASPYWSNESEIGINTVWNDTYLQDTEGGRYRNNETFAVDDIYKMGFAKCHIDNLEQFQIHAFVLAPIFVGQKLWGLLATYQHTGPRQWKASEVNFLSQIAAQMGVALQQAELLTQTRQQTLNLQQAAEQQRVLFEVVAKVRKSLDLDAIFQTTTQEICKSLQADRVAVFQFQADWSGEYIAEFVGDGWVKLVGSNTKTVWQDSYLQETQGGRYRHNETFAVDDIYQVGHSQCHVAVLEQIQARAYAIAPIFIGQQLWGLLAAYQNSAPRHWEASEIKFITQIANQLGVALQQAQLHNQTKEQTEKLTQALHDLKQTQTQLIQTEKMSSLGQLVAGVAHEINNPVNFIYGNINHVNNYAQDLLGILDLYLQNTPNPSPEIRDRTFEIDLEFLIEDLPKTLSSMKIGVDRIRQIVLGLRNFSRLDEAEMKPVDIHEGIDSTLLILQHRLKAKPESPAIKLVKEYSELPLVECYAGPLNQVFMNVLSNAIDALEDYRESPSKPHSSQITICTAIGELEGNIKSVVIRIADNGSGIPEALKARICDPFFTTKPVGKGTGLGLSISYQIVVDKHGGVFKCDSQPGLGTEFWIEIPVSQITKF

SEQ ID NO: 121 - protein, 1204 aa, Nostoc punctiforme
MEFLTNQVSQTQEILLHRIASRIRQSLELQEILSATVAEVRSFLGTDRIKIYQFQADGHGLVIAESIQEDRLPPLLGLNFPADDIPPYARELFVRARQRCIVDLTTQEIGISPLDCPETGKPLEQQDIRYRPVDPCHLEYLTAMGVKSSVVVPIVLKNQETGKDSSPNVMESSQLWGLLVSHHSQARVVTQQELLLIQSVVDQVAIAISQSILLTQVREQARQEAIINKVTEQLHSTPVAQLQTALEETVAAFNGSGGRLYLLPDDEQTAKLYTFGLQPNQLDIGQEQTPSPLTQELSLVDRAWVSPMERNNEVLLLANLREGSDVLRKGRPIEEHRLWQKYLFASICPPENLENPSHKSWSVNWMRAIYALTPPVNELSYDSNLWAIADLYKEPLLRSVAPCFQTTQVRGLLIVPLQHGSTIVGCLTIFRDEVDIETIWAGCVDTDSRQLMPRQSFAAWRELRTGQAQQWSESEIKLAQALGERFATAVKQHRLYEQVQALNANLEQQVRDRTLELQQTNTDLQHSTIELQRSVERQQALARIIANMRQSLDVTTIFRTTTQEVCQLLECDRLSVYRFNADWGGEFVGDYETANPRWGRSIKLGVGMVWDDTYLQETQGGRYRNNETFVVDDIHSQGFTQCHIEILEQFHVQAFMIAPIFVGQELWGLLGAYQHSSTRHWQASEIEFFTQIATQLGVALQQAEYLEQVRAQTRKLALVAEQQQTLASVITKIRESLDLNAIFETTTQELRRVLNCDRVVIFRFYSESNYDGGEVIAEDVAERFLSTLTAKVYDRCLGQEHIEKFCQGYVHAVTDIYNSELNECYVSMLSRFQVRANLVIPMLKQGQLWGLLGIHQCQKSREWQDSEIEFVRQIAAQLGVALQHVVLLNQTQQQAIQLAQALEHLQQTQAHLLHSEKMSSLGLLVAGVAHEINNPVNFISGNLSHLHEYTQSLIKMLNIYQQIYPQPHPEIEKQAILSDLEFIAEDLPKLFSSLKIGAERIGEIVLSLRNFSRLDQAQVKPVDIHEGLDSTLLILQHRLKANSLHLGIEIVKQYASLPLIECFAGQLNQVFMNLLANAIDAVEEPCRQPAKSDKDKHYPRITIKTQLIANDWVQIYIKDNGVGMTKAVQAKLFDPFFTTKPVGQGTGLGLSISYQIVEKHGGKLQCLSQPGEGAQFVIEIPIKQSERELANVLIDKKESDTDNS

SEQ ID NO: 122 - protein, 910 aa, Nostoc punctiforme
MTSTDKPNGLQQSLEQESLLHRMIKQIRRSLDLQEILTTTVTEVRSFLRADRVKVYRFDTSGSGEVIAESIHNERLPSLLGLRFPVHDIPEAAREMFLLAGQRSIVDVANHKIGLSPLQSTETGKHLQTNIYYRKVDPCHIQYLKAMGVQSSLVVPILDSDPQQSAKPKLWGLLVSHQSKPRKILKREIKVLQQVADQVAIAIAQSNLLTAALTQQKQEATINRVTTLLHKLPTIQLQGAIEEVITAFSGVGGRLYIEQSRELYTWGDQPTLPYELDSSIIEQHPTWQNWMTECQPGNIWATSDLYKEPHLRVLALAFRSTQIRGLMVIPLHYREQFIGVLSIFRAEFETEILWAGRCEQNRRQLLPQLSFEIWREQKKGLAPEWKPEDMTLAQALYDHFSMAIQQQQIYKEVQALNANLELRVQEQTAELEKSLLLTKVIKQITEQIRRTLDLQTTLQTIVSEVRSLLNSDRVVIFQLNSKSVIVEEMNGNWQSVLGVNAPPECFPNEHRDLYSQGRVRAINNVSTDSLSDCHREFLQSLQIQANLTVPINIGIELWGLLIAHECNTPRNWQDVEIDLLQQLGDQAAIAIQQAQLYEQTCKAETEARNKAGELGQTLHKLQETQTRLIQTEKMSGLGQLVAGIAHEINNPVNFIYGNLCHASDYIEQLLEILRLYQLHYPDPHSEISAAIEAVDFEFLVEDLPRIITSMQVGSDRIRSIVLSLRNFSRLDEAENKRVDLHEGIDNTLLILQHQLKGNGKFPGIQVIKDYGNIPKVECYAGQMNQVFMNIFSNAIDALEMGTAEEDKENKPSPVPTIRISTKISADNSRLLIRISDNGPGMIPEIKKRIFDPFYTTKPVGRGTGLGLAISYQIIVEKHGGIMECISEPGIGTEFWIEIPVKPPAKIVYSR

SEQ ID NO: 123 - DNA, 28 bp, Artificial
  PCR Primer - Synthetic oliconucleotide.
agagctcatgtcaggctctaggccgact

SEQ ID NO: 124 - DNA, 33 bp, Artificial
  PCR Primer - Synthetic oliconucleotide.
ctagtcgacctacttgtttgctgcagcgagttc

SEQ ID NO: 125 - DNA, 44 bp, Artificial
  PCR Primer - Synthetic oliconucleotide.
ggtatgacagggtgatggctcataagtttcatgaagatgatcac

SEQ ID NO: 126 - DNA, 44 bp, Artificial
  PCR Primer - Synthetic oliconucleotide.
gtgatcatcttcatgaaacttatgagccatcaccctgtcatacc

SEQ ID NO: 127 - DNA, 29 bp, Artificial
  PCR Primer - Synthetic oliconucleotide.
ggaattcgaattgcgctgtctagataaga

SEQ ID NO: 128 - DNA, 34 bp, Artificial
  PCR Primer - Synthetic oliconucleotide.
agagctcggatcccctttttcctgacacagagac

SEQ ID NO: 129 - DNA, 43 bp, Artificial
  PCR Primer - Synthetic oliconucleotide.
ggttatgatcgtgttatggttcataagtttcatgaagatgagc

SEQ ID NO: 130 - DNA, 43 bp, Artificial
  PCR Primer - Synthetic oliconucleotide.
gctcatcttcatgaaacttatgaaccataacacgatcataacc

SEQ ID NO: 131 - DNA, 43 bp, Artificial
  PCR Primer - Synthetic oliconucleotide.
ggttatgatcgtgttatggttattaagtttcatgaagatgagc

SEQ ID NO: 132 - DNA, 43 bp, Artificial
  PCR Primer - Synthetic oliconucleotide.
gctcatcttcatgaaacttaataaccataacacgatcataacc

SEQ ID NO: 133 - DNA, 42 bp, Artificial
  PCR Primer - Synthetic oliconucleotide.
gttatgatcgtgttatggttcaaaagtttcatgaagatgagc

SEQ ID NO: 134 - DNA, 42 bp, Artificial
  PCR Primer - Synthetic oliconucleotide.
gctcatcttcatgaaacttttgaaccataacacgatcataac

SEQ ID NO: 135 - DNA, 41 bp, Artificial
  PCR Primer - Synthetic oliconucleotide.
ttatgatcgtgttatggttcgtaagtttcatgaagatgagc

SEQ ID NO: 136 - DNA, 41 bp, Artificial
  PCR Primer - Synthetic oliconucleotide.
gctcatcttcatgaaacttacgaaccataacacgatcataa

SEQ ID NO: 137 - DNA, 21 bp, Artificial
  PCR Primer - Synthetic oliconucleotide.
taaggccgtcaagctttcccc

SEQ ID NO: 138 - DNA, 20 bp, Artificial
  PCR Primer - Synthetic oliconucleotide.
taccatgggctgcctgatgg

SEQ ID NO: 139 - DNA, 21 bp, Artificial
  PCR Primer - Synthetic oliconucleotide.
taaggccgtcaagctttcccc

SEQ ID NO: 140 - DNA, 20 bp, Artificial
  PCR Primer - Synthetic oliconucleotide.
taccatgggctgcctgatgg

SEQ ID NO: 141 - DNA, 21 bp, Artificial
  PCR Primer - Synthetic oliconucleotide.
atgaagattaaggtcgtggca

SEQ ID NO: 142 - DNA, 17 bp, Artificial
  PCR Primer - Synthetic oliconucleotide.
gagtttgaagaggctac

SEQ ID NO: 143 - DNA, 43 bp, Artificial; identical to SEQ ID NO: 129
  PCR Primer - Synthetic oliconucleotide.

SEQ ID NO: 144 - DNA, 43 bp, Artificial; identical to SEQ ID NO: 130
  PCR Primer - Synthetic oliconucleotide.

SEQ ID NO: 145 - DNA, 43 bp, Artificial; identical to SEQ ID NO: 131
  PCR Primer - Synthetic oliconucleotide.

SEQ ID NO: 146 - DNA, 43 bp, Artificial; identical to SEQ ID NO: 132
  PCR Primer - Synthetic oliconucleotide.

SEQ ID NO: 147 - DNA, 42 bp, Artificial; identical to SEQ ID NO: 133
  PCR Primer - Synthetic oliconucleotide.

SEQ ID NO: 148 - DNA, 42 bp, Artificial; identical to SEQ ID NO: 134
  PCR Primer - Synthetic oliconucleotide.

SEQ ID NO: 149 - DNA, 41 bp, Artificial; identical to SEQ ID NO: 135
  PCR Primer - Synthetic oliconucleotide.

SEQ ID NO: 150 - DNA, 41 bp, Artificial; identical to SEQ ID NO: 136
  PCR Primer - Synthetic oliconucleotide.

SEQ ID NO: 151 - DNA, 28 bp, Artificial
  PCR Primer - Synthetic oliconucleotide.
agagctcatgtcaggctctaggccgact

SEQ ID NO: 152 - DNA, 33 bp, Artificial; identical to SEQ ID NO: 124
  PCR Primer - Synthetic oliconucleotide.

SEQ ID NO: 153 - DNA, 44 bp, Artificial; identical to SEQ ID NO: 125
  PCR Primer - Synthetic oliconucleotide.

SEQ ID NO: 154 - DNA, 44 bp, Artificial; identical to SEQ ID NO: 126
  PCR Primer - Synthetic oliconucleotide.

SEQ ID NO: 155 - DNA, 29 bp, Artificial
  PCR Primer - Synthetic oliconucleotide.
ggaattcgaattgcgctgtctagataaga

SEQ ID NO: 156 - DNA, 34 bp, Artificial; identical to SEQ ID NO: 128
  PCR Primer - Synthetic oliconucleotide.

SEQ ID NO: 157 - DNA, 21 bp, Artificial
  PCR Primer - Synthetic oliconucleotide.
taaggccgtcaagctttcccc

SEQ ID NO: 158 - DNA, 20 bp, Artificial
  PCR Primer - Synthetic oliconucleotide.
taccatgggctgcctgatgg

SEQ ID NO: 159 - DNA, 21 bp, Artificial
  PCR Primer - Synthetic oliconucleotide.
cgcatcaccaacagtgaacac

SEQ ID NO: 160 - DNA, 21 bp, Artificial
  PCR Primer - Synthetic oliconucleotide.
ttcctccgtcagatgcatgtg

SEQ ID NO: 161 - DNA, 21 bp, Artificial
  PCR Primer - Synthetic oliconucleotide.
atgaagattaaggtcgtggca

SEQ ID NO: 162 - DNA, 20 bp, Artificial
  PCR Primer - Synthetic oliconucleotide.
tccgagtttgaagaggctac

What is claimed is:

1. A recombinant mutant phytochrome polypeptide, wherein:

said mutant phytochrome is a mutant plant phytochrome B polypeptide comprising a mutation at the position corresponding to tyrosine residue 276 in an *Arabidopsis* phytochrome B where said mutation is to a residue other than tyrosine; and said mutant phytochrome polypeptide, when present in a plant is a constitutively active light-stable phytochrome, and results in altered photomorphogenesis as compared to the same species or variety of plant lacking the mutant phytochrome.

2. The mutant phytochrome polypeptide of claim 1, wherein phtyochrome is a mutant of a photochrome from a food or forage crop.

3. The mutant phytochrome polypeptide of claim 1, wherein phtyochrome is a mutant of a photochrome from a food crop selected from the group consisting of a cereal, a fruit, a legume, and a root crop.

4. The mutant phytochrome polypeptide of claim 1, wherein phtyochrome is a mutant of a photochrome from a food crop selected from the group consisting of maize (corn), rice, sorghum, wheat, barley, oat, soy, quinoa, potatoes, canola, lettuce, fruit, and beets.

5. The mutant phytochrome polypeptide of claim 1, wherein phtyochrome is a mutant of a photochrome from a food crop selected from the group consisting of Poaceae, Cucurbitaceae, Malvaceae, Asteraceae, Chenopodiaceae, Solanaceae and Brassicaceae.

6. The mutant phytochrome polypeptide of claim 1, wherein phtyochrome is a mutant of a photochrome from a non-food crop.

* * * * *